(12) United States Patent
Lewis et al.

(10) Patent No.: US 7,790,862 B2
(45) Date of Patent: Sep. 7, 2010

(54) IL-17 AND IL-23 ANTAGONISTS AND METHODS OF USING THE SAME

(75) Inventors: Katherine E. Lewis, Lake Forest Park, WA (US); Scott R. Presnell, Tacoma, WA (US); James W. West, Seattle, WA (US); Robert Mabry, Seattle, WA (US); Steven D. Levin, Seattle, WA (US)

(73) Assignee: ZymoGenetics, Inc., Seattle, WA (US)

( * ) Notice: Subject to any disclaimer, the term of this patent is extended or adjusted under 35 U.S.C. 154(b) by 0 days.

(21) Appl. No.: 11/762,738

(22) Filed: Jun. 13, 2007

(65) Prior Publication Data

US 2008/0095775 A1    Apr. 24, 2008

Related U.S. Application Data

(60) Provisional application No. 60/804,602, filed on Jun. 13, 2006, provisional application No. 60/824,665, filed on Sep. 6, 2006, provisional application No. 60/828,277, filed on Oct. 5, 2006, provisional application No. 60/891,410, filed on Feb. 23, 2007.

(51) Int. Cl.
*C12P 21/08* (2006.01)

(52) U.S. Cl. ............. 530/388.1; 530/387.3; 530/387.9; 530/351

(58) Field of Classification Search .................. None
See application file for complete search history.

(56) References Cited

U.S. PATENT DOCUMENTS

| | | | |
|---|---|---|---|
| 6,495,667 B1 * | 12/2002 | Bazan | 530/389.2 |
| 7,183,382 B2 | 2/2007 | Oppmann et al. | |
| 7,252,971 B2 | 8/2007 | Benson et al. | |
| 7,422,743 B2 | 9/2008 | Chirica et al. | |
| 7,427,402 B2 | 9/2008 | Kastelein et al. | |
| 7,485,297 B2 * | 2/2009 | Wood et al. | 424/130.1 |
| 7,491,391 B2 | 2/2009 | Benson et al. | |
| 7,608,690 B2 | 10/2009 | Bazan | |
| 2003/0180256 A1 | 9/2003 | Hirata | |
| 2004/0258686 A1 | 12/2004 | Chirica et al. | |
| 2005/0043517 A1 | 2/2005 | Giles-Komar et al. | |
| 2005/0158750 A1 | 7/2005 | Bazan | |
| 2005/0208052 A1 | 9/2005 | Katsikis et al. | |
| 2005/0244874 A1 | 11/2005 | Kastelein et al. | |
| 2006/0134112 A1 | 6/2006 | Cua et al. | |
| 2007/0009526 A1 | 1/2007 | Benson et al. | |
| 2007/0048306 A1 | 3/2007 | Giles-Komar et al. | |
| 2007/0048315 A1 | 3/2007 | Presta | |
| 2007/0059803 A1 | 3/2007 | Oppmann et al. | |
| 2007/0098727 A1 | 5/2007 | Kastelein et al. | |
| 2007/0166795 A1 | 7/2007 | Hirata | |
| 2008/0038831 A1 | 2/2008 | Benson et al. | |
| 2008/0299129 A1 | 12/2008 | Lewis et al. | |

FOREIGN PATENT DOCUMENTS

| | | |
|---|---|---|
| WO | WO 99/05280 | 2/1999 |
| WO | WO 99/40195 | 8/1999 |
| WO | WO 99/54357 | 10/1999 |
| WO | WO 01/18051 | 3/2001 |
| WO | WO 03/082206 | 10/2003 |
| WO | WO 03/091700 | 11/2003 |
| WO | WO 2004/058178 | 7/2004 |
| WO | WO 2004/060291 | 7/2004 |
| WO | WO 2004/071517 | 8/2004 |
| WO | WO2004/071517 | 8/2004 |
| WO | WO 2004/081190 | 9/2004 |
| WO | 2005/010044 | 2/2005 |
| WO | WO 2005/037314 | 4/2005 |
| WO | WO 2005/079837 | 9/2005 |
| WO | WO2006/013107 | 2/2006 |
| WO | WO2006/054059 | 5/2006 |
| WO | WO 2007/005955 | 1/2007 |
| WO | 2007/027761 | 3/2007 |
| WO | WO 2007/024846 | 3/2007 |
| WO | WO 2007/027761 | 3/2007 |
| WO | WO 2007/051169 | 5/2007 |
| WO | WO 2007/076523 | 7/2007 |
| WO | WO 2007/076524 | 7/2007 |
| WO | 2007/106769 | 9/2007 |
| WO | WO 2007/109238 | 9/2007 |
| WO | 2007/147019 | 12/2007 |
| WO | WO 2008/079279 | 7/2008 |
| WO | WO 2008/103432 | 8/2008 |
| WO | WO 2008/103473 | 8/2008 |
| WO | WO 2008/106131 | 9/2008 |
| WO | WO 2009/082624 | 7/2009 |

OTHER PUBLICATIONS

Bowman et al., "Rationale and safety of anti-interleukin-23 and anti-interleukin-17A therapy," *Current Opinion in Infectious Diseases* (19)3: 245-252, 2006.
McKenzie et al., *Trends in Immunology*, 27(1): 17-23, 2006.
Chen et al., *Journal of Clinical Investigation*, 116(5): 1317-1326, 2006.

* cited by examiner

*Primary Examiner*—Dong Jiang
(74) *Attorney, Agent, or Firm*—Robyn Adams

(57) ABSTRACT

The present invention relates to blocking, inhibiting, reducing, antagonizing or neutralizing the activity of IL-17, IL-23 via it's p19 subunit or both IL-17 and IL-23 (via p19). IL-17 and IL-23 are cytokines that are involved in inflammatory processes and human disease.

14 Claims, No Drawings

IL-17 AND IL-23 ANTAGONISTS AND METHODS OF USING THE SAME

CROSS-REFERENCE TO RELATED APPLICATIONS

This application claims the benefit of U.S. Provisional Application Ser. No. 60/804,602, filed Jun. 13, 2006, U.S. Provisional Application Ser. No. 60/824,665, filed Sep. 6, 2006, U.S. Provisional Application Ser. No. 60/828,277, filed Oct. 5, 2006, and U.S. Provisional Application Ser. No. 60/891,410, filed Feb. 23, 2007, all of which are herein incorporated by reference.

FIELD OF THE INVENTION

The present invention relates generally to the identification and isolation of antagonists to IL-17 and IL-23 (via p 19) and methods of using the same.

BACKGROUND OF THE INVENTION

The immune system protects individuals from infective agents (e.g. viruses, bacteria, and multi-cellular organisms), as well as from cancer and neoplasms. The immune system includes many lymphoid and myeloid cell types such as neutrophils, monocytes, macrophages, dendritic cells (DCs), eosinophils, T cells, and B cells. These cells are capable of producing signaling proteins known as cytokines. Cytokines are soluble, small proteins that mediate a variety of biological effects, including the induction of immune cell proliferation, development, differentiation, and/or migration, as well as the regulation of the growth and differentiation of many cell types (see, for example, Arai et al., *Annu. Rev. Biochem.* 59:783 (1990); Mosmann, *Curr. Opin. Immunol* 3:311 (1991); Paul and Seder, *Cell* 76:241 (1994)). Cytokine-induced immune functions can also include an inflammatory response, characterized by a systemic or local accumulation of immune cells. Although they do have host-protective effects, these immune responses can produce pathological consequences when the response involves excessive and/or chronic inflammation, as in autoimmune disorders (such as multiple sclerosis) and cancer/neoplastic diseases (Oppenheim and Feldmann (eds.) *Cytokine Reference*, Academic Press, San Diego, Calif. (2001); von Andrian and Mackay *New Engl J. Med.* 343. 1020 (2000); Davidson and Diamond, *New Engl J. Med.* 345:340 (2001); Lu et al., *Mol. Cancer Res.* 4:221 (2006); Dalgleish and O'Byrne, *Cancer Treat Res.* 130:1 (2006)).

Proteins that constitute the cytokine group include interleukins, interferons, colony stimulating factors, tumor necrosis factors, and other regulatory molecules. For example, human interleukin-17A (also known as "IL-17") is a cytokine which stimulates, for example, the expression of interleukin-6 (IL-6), intracellular adhesion molecule 1 (ICAM-1), interleukin-8 (IL-8), granulocyte macrophage colony-stimulating factor (GM-CSF), and prostaglandin E2, and plays a role in the preferential maturation of CD34+ hematopoietic precursors into neutrophils (Yao et al., *J. Immunol.* 155:5483 (1995); Fossiez et al., *J. Exp. Med.* 183:2593 (1996)). As another example, human interleukin-23 (also known as "IL-23") is a cytokine which has been reported to promote the proliferation of T cells, in particular memory T cells and can contribute to the differentiation and/or maintenance of Th17 cells.

Accordingly, the demonstrated in vivo activities of cytokines and their receptors illustrate the clinical potential of, and need for, other cytokines, cytokine receptors, cytokine agonists, and cytokine antagonists. For example, demonstrated in vivo activities of the pro-inflammatory cytokine family illustrates the enormous clinical potential of, and need for antagonists of pro-inflammatory molecules such as IL-17A and IL-23.

DETAILED DESCRIPTION OF THE INVENTION

The present invention addresses these needs by providing antagonists to pro-inflammatory cytokines IL-17 (also interchangeably referred to as "IL-17A" herein) (SEQ ID NOS: 1 & 2) and the p19 subunit (SEQ ID NOS:3 & 4) of IL-23 (SEQ ID NOS:5 & 6).

IL-17 is a cytokine which stimulates the expression of IL-6, ICAM-1, IL-8, GM-CSF, and prostaglandin E2, among others, and plays a role in the preferential maturation of CD34+ hematopoietic precursors into neutrophils (Yao et al., *J. Immunol.* 155:5483 (1995); Fossiez et al., *J. Exp. Med.* 183:2593 (1996)).

IL-23 is a heterodimeric cytokine composed of a unique subunit, p19 (herein referred to interchangeably as "IL-23", "p19" and "IL23/p19"), and the p40 subunit, which is shared with interleukin-12 (IL-12) (Oppmann, *Immunity* 13:715 (2000)). IL-23 has been found to stimulate the production and/or maintenence of IL-17 A and F from activated CD4+ T cells in what has now been termed as a "new" T-helper (Th) subset, designated Th17. A review of IL-23 cytokine and receptor biology is reviewed in Holscher, *Curr. Opin. Invest. Drugs* 6:489 (2005) and Langrish et al. *Immunol Rev.* 202:96 (2004). Similar to Th1 and Th2 lineages, Th17 cells have most likely evolved to provide adaptive immunity to specific classes of pathogens, such as extracellular bacteria. However, inappropriate Th17 responses have been strongly implicated in a growing list of autoimmune disorders, including multiple sclerosis, rheumatoid arthritis, inflammatory bowel disease, and psoriasis.

In fact, both IL-17 and IL-23 have also been reported to play important roles in many autoimmune diseases, such as multiple sclerosis, rheumatoid arthritis, Crohn's disease, and psoriasis. Both IL-23 and IL-17 are overexpressed in the central nervous system of humans with multiple sclerosis and in mice undergoing an animal model of multiple sclerosis, experimental autoimmune encephalomyelitis (EAE). The overexpression is observed in mice when the EAE is induced by either myelin oligodendrocyte glycoprotein (MOG) 35-55 peptide- or proteolipid peptide (PLP). Furthermore, neutralization of either IL-23/p19 or IL-17 results in amelioration of EAE symptoms in mice (Park et al., *Immunol* 6:1133 (2005); Chen et al., *J Clin Invest.* 116:1317 (2006)).

It has also been demonstrated that IL-17 and Th17 cells can be produced from IL-23-independent sources, and the in vivo development of an IL-17 effector response has been shown to be IL-23-independent (Mangan et al., *Nature* 441:231 (2006)). Neutralization of IL-23 would theoretically eliminate existing IL-17 producing cells, but would not completely prevent the development of new Th17 cells.

An important regulator of IL-23 independent production of Th17 is transforming growth factor-beta (TGF-b). It has been repeatedly demonstrated that TGF-b (including TGF-b1) is critical for commitment to Th17 development, independent from IL-23 (Mangan et al., *Nature.* 441:231 (2006)). This is further supported by the fact that development of Th17 cells is markedly impaired in mice deficient in TGF-b1 (Mangan et al., *Nature.* 441:231 (2006)). The idea that TGF-b1 appears to have both anti- and pro-inflammatory roles may be due in part to the fact that it can induce the expression of the pro-inflammatory cytokine IL-17 and Foxp3 (the transcription factor for the CD4+ CD25+ regulatory T cell population), but by distinct CD4+ T cell subpopulations (Mangan et al., *Nature.* 441:231 (2006)).

Receptors that bind cytokines are typically composed of one or more integral membrane proteins that bind the cytokine with high affinity and transduce this binding event to the cell through the cytoplasmic portions of the certain receptor subunits. Cytokine receptors have been grouped into several classes on the basis of similarities in their extracellular ligand binding domains. IL-17 mediates its effects through interaction with its cognate receptor, the IL-17 receptor (IL-17R) as well as IL-17RC. The IL-23 and IL-12 receptors share a subunit, IL-12Rb-1 that pairs with unique, inducible components, IL-23R and IL-12Rb-2, respectively, which in turn is responsible for receptor responsiveness. One of the actions of TGF-b in this respect is to upregulate IL-23R expression, which in turn, induces responsiveness to IL-23.

The present invention concerns the inhibition of both of these proinflammatory cytokines, IL-17 and IL-23/p19. The present invention is based on the surprising discovery that antagonizing both IL-23 (via p19) and IL-17 is more effective therapeutically than neutralization of IL-23 alone (either via p19 or p40) or IL-17 alone and thus, necessary for the effective treatment of inflammatory diseases (including cancers). More specifically, the present invention concerns the inhibition or neutralization of both IL-17 and IL-23 (via p19) with a single antagonistic molecule or neutralizing entity.

The antagonistic molecule or neutralizing entity inhibits the activity of both IL-17 and IL-23 (via p19), and thus, inhibits the production, maintenance, and activity of new and existing IL-17 and IL-17-producing T cells (Th17). TH17 cells include IL-17A and IL-17F. The invention further concerns the use of IL-17 and IL-23/p19 antagonists or neutralizing entities in the treatment of inflammatory diseases characterized by the presence of elevated levels of IL-17 and/or IL-23. The invention also concerns the use of IL-17 and IL-23/p19 antagonists in the treatment of cancers characterized by the presence of elevated levels of IL-17 and/or IL-23.

Accordingly, the present invention is directed to antagonizing both IL-17 and IL-23/p19, either singly or together. Since either IL-17, IL-23/p19, or IL-23/p40 intervention has been proposed as an effective therapy for several inflammatory diseases and various cancers, using antagonists of the present invention, which may block, inhibit, reduce, antagonize or neutralize the activity of IL-17, IL-23, IL-23/p19 or both IL-17A and IL-23 (via p19), will have advantages over therapies that target only one of these two cytokines. The invention further provides uses therefore in inflammatory disease and cancer, as well as related compositions and methods.

A) Overview

Immune related and inflammatory diseases are the manifestation or consequence of fairly complex, often multiple interconnected biological pathways which in normal physiology are critical to respond to insult or injury, initiate repair from insult or injury, and mount innate and acquired defense against foreign organisms. Disease or pathology occurs when these normal physiological pathways cause additional insult or injury either as directly related to the intensity of the response, as a consequence of abnormal regulation or excessive stimulation, as a reaction to self, or as a combination of these.

Though the genesis of these diseases often involves multistep pathways and often multiple different biological systems/pathways, intervention at critical points in one or more of these pathways can have an ameliorative or therapeutic effect. Therapeutic intervention can occur by either antagonism of a detrimental process/pathway or stimulation of a beneficial process/pathway.

Many immune related diseases are known and have been extensively studied. Such diseases include immune-mediated inflammatory diseases (such as rheumatoid arthritis, multiple sclerosis, demyelinating diseases, autoimmune ocular diseases, uveitis; scleritis, immune mediated renal disease, hepatobiliary diseases, inflammatory bowel disease (IBD), irritable bowel syndrome (IBS), psoriasis, and asthma), non-immune-mediated inflammatory diseases, infectious diseases, immunodeficiency diseases, neoplasia, etc.

T lymphocytes (T cells) are an important component of a mammalian immune response. T cells recognize antigens which are associated with a self-molecule encoded by genes within the major histocompatibility complex (MHC). The antigen may be displayed together with MHC molecules on the surface of antigen-presenting cells, virus-infected cells, cancer cells, grafts, etc. The T cell system eliminates these altered cells which pose a health threat to the host mammal. T cells include helper T cells and cytotoxic T cells. Helper T cells proliferate extensively following recognition of an antigen-MHC complex on an antigen presenting cell. Helper T cells also secrete a variety of cytokines, i.e., lymphokines, which play a central role in the activation of B cells, cytotoxic T cells and a variety of other cells which participate in the immune response.

A central event in both humoral and cell mediated immune responses is the activation and clonal expansion of helper T cells. Helper T cell activation is initiated by the interaction of the T cell receptor (TCR)-CD3 complex with an antigen-MHC on the surface of an antigen-presenting cell. This interaction mediates a cascade of biochemical events that induce the resting helper T cell to enter a cell cycle (the G0 to G1 transition) and results in the expression of a high affinity receptor for IL-2 and sometimes IL-4. The activated T cell progresses through the cycle proliferating and differentiating into memory cells or effector cells.

In addition to the signals mediated through the TCR, activation of T cells involves additional costimulation induced by cytokines released by the antigen presenting cell or through interactions with membrane bound molecules on the antigen presenting cell and the T cell. The cytokines IL-1 and IL-6 have been shown to provide a costimulatory signal. Also, the interaction between the B7 molecule expressed on the surface of an antigen presenting cell and CD28 and CTLA-4 molecules expressed on the T cell surface effect T cell activation. Activated T cells express an increased number of cellular adhesion molecules, such as ICAM-1, integrins, VLA-4, LFA-1, CD56, etc.

T-cell proliferation in a mixed lymphocyte culture or mixed lymphocyte reaction (MLR) is an established indication of the ability of a compound to stimulate the immune system. In many immune responses, inflammatory cells infiltrate the site of injury or infection. The migrating cells may be neutrophilic, eosinophilic, monocytic or lymphocytic as can be determined by histologic examination of the affected tissues. Current Protocols in Immunology, ed. John E. Coligan, 1994, John Wiley & Sons, Inc.

Immune related diseases could be treated by suppressing the immune response. Using the antagonists of the present invention (i.e. anti-IL-17 and/or anti-IL-23/p19 antibodies) that inhibit molecules having immune stimulatory activity would be beneficial in the treatment of immune-mediated and inflammatory diseases. Molecules which inhibit the immune response can be utilized (proteins directly or via the use of antibody agonists) to inhibit the immune response and thus ameliorate immune related disease.

IL-17 has been identified as a cellular ortholog of a protein encoded by the T lymphotropic Herpes virus Saimiri (HSV) [see, Rouvier et al., *J. Immunol.*, 150(12): 5445-5456 (1993); Yao et al., *J. Immunol*, 122(12):5483-5486 (1995) and Yao et al., *Immunity*, 3(6):811-821 (1995)]. Subsequent characterization has shown that this protein is a potent cytokine that acts to induce proinflammatory responses in a wide variety of peripheral tissues. IL-17 is a disulfide-linked homodimeric cytokine of about 32 kDa which is synthesized and secreted primarily by CD4+ activated memory T cells (reviewed in Fossiez et al., *Int. Rev. Immunol,* 16: 541-551 [1998]). Specifically, IL-17 is synthesized as a precursor polypeptide of 155 amino acids with an N-terminal signal sequence of 19-23 residues and is secreted as a disulfide-linked homodimeric glycoprotein. IL-17 is disclosed in WO9518826 (1995), WO9715320 (1997) and WO9704097 (1997), as well as U.S. Pat. No. 6,063,372.

Despite its restricted tissue distribution, IL-17 exhibits pleitropic biological activities on various types of cells. IL-17 has been found to stimulate the production of many cytokines. For example, it induces the secretion of IL-6, IL-8, IL-12, leukemia inhibitory factor (LIF), prostaglandin E2, MCP-1 and G-CSF by adherent cells like fibroblasts, keratinocytes, epithelial and endothelial cells. IL-17 also has the ability to induce ICAM-1 surface expression, proliferation of T cells, and growth and differentiation of CD34.sup.+ human progenitors into neutrophils. IL-17 is also believed to play a key role in certain other autoimmune disorders such as multiple sclerosis (Matusevicius et al., *Mult. Scler.* 5:101 (1999); Park et al., *Nat Immunol.* 6:1133 (2005)). IL-17 has further been shown, by intracellular signalling, to stimulate Ca.sup.2+ influx and a reduction in [cAMP], in human macrophages (Jovanovic et al., *J. Immunol.* 160:3513 (1998)). Fibroblasts treated with IL-17 induce the activation of NF-kappa.B, (Yao et al., *Immunity,* 3:811 (1995), Jovanovic et al., supra), while macrophages treated with it activate NF-kappa.B and mitogen-activated protein kinases (Shalom-Barek et al., *J. Biol. Chem.* 273:27467 (1998)).

Consistent with IL-17's wide-range of effects, the cell surface receptor for IL-17 has been found to be widely expressed in many tissues and cell types (Yao et al., *Cytokine,* 9:794 (1997)). While the amino acid sequence of the human IL-17 receptor (IL-17R) (866 amino acids) predicts a protein with a single transmembrane domain and a long, 525 amino acid intracellular domain, the receptor sequence is unique and is not similar to that of any of the receptors from the cytokine/growth factor receptor family. This coupled with the lack of similarity of IL-17 itself to other known proteins indicates that IL-17 and its receptor may be part of a novel family of signalling proteins and receptors. It has been demonstrated that IL-17 activity is mediated through binding to its unique cell surface receptor, wherein previous studies have shown that contacting T cells with a soluble form of the IL-17 receptor polypeptide inhibited T cell proliferation and IL-2 production induced by PHA, concanavalin A and anti-TCR monoclonal antibody (Yao et al., *J. Immunol,* 155:5483 (1995)).

IL-17 and IL-23 appear to represent a unique signaling system within the cytokine network that will offer innovative approaches to the manipulation of immune and inflammatory responses.

As such, antagonists to IL-17 and IL-23 activity, such as the antagonists of the present invention (i.e. anti-IL-17 and/or anti-IL-23/p19 antibodies), are useful in therapeutic treatment of inflammatory diseases, particularly as antagonists to both IL-17 and IL-23/p19, either singly or together in the treatment of inflammatory diseases, particularly as antagonists to both IL-17 and IL-23/p19 in the treatment of multiple sclerosis, inflammatory bowel disease (IBD), rheumatoid arthritis, psoriasis, and cancer. Moreover, antagonists to IL-17 and IL-23/p19 activity, such as the antagonists of the present invention (i.e. anti-IL-17 and/or anti-IL-23/p19 antibodies), are useful in therapeutic treatment of other inflammatory diseases. These antagonists are capable of binding, blocking, inhibiting, reducing, antagonizing or neutralizing IL-17 and IL-23 (via p19) (either individually or together) in the treatment of atopic and contact dermatitis, colitis, endotoxemia, arthritis, rheumatoid arthritis, psoriatic arthritis, autoimmune ocular diseases (uveitis, scleritis), adult respiratory disease (ARD), demyelinating diseases, septic shock, multiple organ failure, inflammatory lung injury such as asthma, chronic obstructive pulmonary disease (COPD), airway hyper-responsiveness, chronic bronchitis, allergic asthma, psoriasis, eczema, IBS and inflammatory bowel disease (IBD) such as ulcerative colitis and Crohn's disease, diabetes, *Helicobacter pylori* infection, intraabdominal adhesions and/or abscesses as results of peritoneal inflammation (i.e. from infection, injury, etc.), systemic lupus erythematosus (SLE), multiple sclerosis, systemic sclerosis, nephrotic syndrome, organ allograft rejection, graft vs. host disease (GVHD), kidney, lung, heart, etc. transplant rejection, streptococcal cell wall (SCW)-induced arthritis, osteoarthritis, gingivitis/periodontitis, herpetic stromal keratitis, restenosis, Kawasaki disease, and cancers/neoplastic diseases that are characterized by IL-17 and/or IL-23 expression, including but not limited to prostate, renal, colon, ovarian and cervical cancer, and leukemias (Tartour et al, *Cancer Res.* 59:3698 (1999); Kato et al, *Biochem. Biophys. Re.s Commun.* 282:735 (2001); Steiner et al, *Prostate.* 56:171 (2003); Langowksi et al, *Nature* 442: 461, 2006).

Amongst other inventions, the present invention provides novel antagonists of IL-17 and IL-23/p19 and their uses in the treatment of inflammatory diseases and autoimmune diseases. The IL-17 and IL-23/p19 antagonists of the present invention, including the neutralizing anti-IL-17 and IL-23/p19 antibodies of the present invention, can be used to block, inhibit, reduce, antagonize or neutralize the activity of either IL-17 or IL-23 (via p19), or both IL-17 and IL-23 (via p19) in the treatment of inflammation and inflammatory dieases such as multiple sclerosis, cancer (as characterized by the expression of IL-17 and/or IL-23), psoriasis, psoriatic arthritis, rheumatoid arthritis, autoimmune ocular diseases, endotoxemia, IBS, and inflammatory bowel disease (IBD), colitis, asthma, allograft rejection, immune mediated renal diseases, hepatobiliary diseases, atherosclerosis, promotion of tumor growth, or degenerative joint disease and other inflammatory conditions disclosed herein.

The present invention provides isolated polypeptides that bind IL-17 (e.g., human IL-17 polypeptide sequence as shown in SEQ ID NO:2). The present invention also provides isolated polypeptides as disclosed above that bind IL-23 (e.g., human IL-23 polypeptide sequence as shown in SEQ ID NO:6). More specifically, the present invention provides polypeptides that bind to the p19 subunit of IL-23 (e.g. human p19 polypeptide sequence as shown in SEQ ID NO:4).

The present invention also provides isolated polypeptides and epitopes comprising at least 15 contiguous amino acid residues of an amino acid sequence of SEQ ID NO:2 or 4. Illustrative polypeptides include polypeptides that either comprise, or consist of SEQ ID NO:2 or 4, an antigenic epitope thereof. Moreover, the present invention also provides isolated polypeptides as disclosed above that bind to, block, inhibit, reduce, antagonize or neutralize the activity of IL-17 or IL-23.

Preferred embodiments of the invention include binding peptides, antibodies, and any fragments or permutations thereof that bind to IL-17 or IL-23/p19 (herein referred to interchangeably as "IL-17/IL-23 antagonists", "IL-17 antagonists", "IL-23 antagonists", "p19 antagonists", "IL-17/IL-23 antibodies", "IL-17/p19 antibodies", "IL-17 antibodies", "IL-23 antibodies", "p19 antibodies", "IL-17/IL-23/p 19 antibodies", IL-17A neutralizing entities, IL-23p19 neturalizing entities, etc.). Specifically, such binding peptides or antibodies are capable of specifically binding to both human IL-17 and IL-23 (via p19) and/or are capable of modulating biological activities associated with either or both IL-17 and IL-23, and thus are useful in the treatment of various diseases and pathological conditions such as inflammation and immune-related diseases.

Thus, the present invention provides antibodies and antibody fragments that specifically bind with IL-17 and/or IL-23 (via p19). Exemplary antibodies include neutralizing antibodies, polyclonal antibodies, murine monoclonal antibodies, chimeric antibodies, humanized antibodies derived from murine monoclonal antibodies, and human monoclonal antibodies. Illustrative antibody fragments include F(ab')$_2$, F(ab)$_2$, Fab', Fab, Fv, scFv, and minimal recognition units. Neutralizing antibodies preferably bind IL-17 or IL-23/p19 such that the interaction of IL-17 and IL-23 with their respective receptors (i.e. IL-17RA or IL-17RC for IL-17; IL-12b1 and IL-23R for IL-23) is blocked, inhibited, reduced, antagonized or neutralized. That is, the neutralizing IL-17 and IL-23/p19 antibodies of the present invention can either bind, block, inhibit, reduce, antagonize or neutralize each of IL-17 or IL-23 singly, or bind, block, inhibit, reduce, antagonize or neutralize IL-17 and IL-23 together. The present invention further includes compositions comprising a carrier and a peptide, polypeptide, or antibody described herein.

The present invention further includes pharmaceutical compositions, comprising a pharmaceutically acceptable carrier and a polypeptide or antibody described herein.

The present invention also contemplates anti-idiotype antibodies, or anti-idiotype antibody fragments, that specifically bind an antibody or antibody fragment that specifically binds a polypeptide comprising the amino acid sequence of SEQ ID NO:2, 4 or any fragment thereof. An exemplary anti-idiotype antibody binds with an antibody that specifically binds a polypeptide consisting of SEQ ID NOS:2 or 4.

The present invention also provides fusion proteins, comprising an antagonist of the present invention and an immunoglobulin moiety. In such fusion proteins, the immunoglobulin moiety may be an immunoglobulin heavy chain constant region, such as a human Fc fragment. The present invention further includes isolated nucleic acid molecules that encode such fusion proteins.

In a particular embodiment, the present invention provides bispecific antibodies or binding proteins that bind both IL-17 and IL-23. Bispecific antibodies (BsAbs) are antibodies that have two different antigen binding sites, such that the antibody specifically binds to two different antigens. Antibodies having higher valencies (i.e., the ability to bind to more than two antigens) can also be prepared; they are referred to as multispecific antibodies.

The bispecific antibody can be a monoclonal antibody (MAb) with respect to each target. In particular embodiments, the antibody is chimeric, or humanized, or fully human. Fully human antibodies may be generated by procedures that involve immunizing transgenic mice, wherein human immunoglobulin genes have been introduced into the mice, as discussed below. Bispecific antibodies of the invention, which bind IL-17 and IL-23 (via p19), are referred to herein as bispecific IL-17/IL-23 antibodies or bispecific IL-17/p19 MAbs.

In yet other particular embodiments, there is provided the hybridoma cell line which produces monoclonal antibodies of the present invention. In another embodiment, the IL-17/IL-23 antibodies are linked to one or more non-proteinaceous polymers selected from the group consisting of polyethylene glycol, polypropylene glycol, and polyoxyalkylene, or to a cytotoxic agent or enzyme, or to a radioisotope, fluorescent compound or chemiluminescent compound.

Typical methods of the invention include methods to treat pathological conditions or diseases in mammals associated with or resulting from increased or enhanced IL-17 and/or IL-23 expression and/or activity. In the methods of treatment, the antibodies of the present invention may be administered which preferably block or reduce the respective receptor binding or activation to their receptor(s). Optionally, the antibodies employed in the methods will be capable of blocking or neutralizing the activity of both IL-17 and IL-23(p19), e.g., a dual antagonist which blocks or neutralizes activity of IL-17A or IL-23. The methods contemplate the use of a single bispecific binding peptide or antibody or a combination of two or more antibodies (each of which specifically binds to either IL-17 or IL-23 via p19).

The invention also provides compositions which comprise IL-17/IL-23 antibodies. Optionally, the compositions of the invention will include pharmaceutically acceptable carriers or diluents. Preferably, the compositions will include one or more IL-17/IL-23 antibodies in an amount which is therapeutically effective to treat a pathological condition or disease.

As such, the present invention concerns compositions and methods useful for the diagnosis and treatment of inflammation or immune-related disease in mammals, including humans. The present invention is based on the identification of the synergistic effect of neutralizing both IL-17 and IL-23 as compared with neutralization of one alone. Immune related diseases can be treated by suppressing or enhancing the immune response. Antibodies that enhance the immune response stimulate or potentiate the immune response to an antigen. Antibodies which stimulate the immune response can be used therapeutically where enhancement of the immune response would be beneficial. Alternatively, antibodies that suppress the immune response attenuate or reduce the immune response to an antigen (e.g., neutralizing antibodies) can be used therapeutically where attenuation of the immune response would be beneficial (e.g., inflammation).

Accordingly, antagonists of the present invention (i.e. antibodies or binding peptides that bind IL-17 and IL-23 either singly or together) are also useful to prepare medicines and medicaments for the treatment of immune-related and inflammatory diseases, including for example, systemic lupus erythematosis, arthritis, rheumatoid arthritis, osteoarthritis, psoriasis, demyelinating diseases of the central and peripheral nervous systems such as multiple sclerosis, idiopathic demyelinating polyneuropathy or Guillain-Barre syndrome, inflammatory bowel disease, colitis, ulcerative colitis, Crohn's disease, gluten-sensitive enteropathy, autoimmune ocular diseases, cancer, neoplastic diseases, and angiogenesis.

In a specific aspect, such medicines and medicaments comprise a therapeutically effective amount of an IL-17/IL-23 antibody with a pharmaceutically acceptable carrier. Preferably, the admixture is sterile.

In a further embodiment, the invention concerns a method of identifying antagonist antibodies of IL-17 and IL-23/p19, said method comprising contacting both IL-17 and p19 with a candidate molecule and monitoring a biological activity mediated by IL-17 and/or IL-23. In another embodiment, the invention concerns a composition of matter comprising an IL-17/IL-23 antagonist antibody which binds both IL-17 and IL-23 in admixture with a carrier or excipient. In one aspect, the composition comprises a therapeutically effective amount of the IL-17/IL-23 antibody. The composition is useful for: (a) reducing infiltration of inflammatory cells into a tissue of a mammal in need thereof, (b) inhibiting or reducing an immune response in a mammal in need thereof, (c) decreasing the proliferation of T-lymphocytes in a mammal in need thereof in response to an antigen, (d) inhibiting the activity of T-lymphocytes, (e) decreasing the vascular permeability, or (f) reducing systemic and/or local concentrations of IL-17 and/or IL-23.

In another embodiment, the invention concerns a method of treating an immune related disorder in a mammal in need thereof, comprising administering to the mammal a therapeutically effective amount of an IL-117/IL-23 antagonist.

Optionally, the antibody is a monoclonal antibody, humanized antibody, antibody fragment or single-chain antibody. In another embodiment, the invention provides an antibody which specifically binds to both IL-17 and IL-23. The antibody may be labeled and may be immobilized on a solid support. In a further aspect, the antibody is an antibody fragment, a monoclonal antibody, a single-chain antibody, or an anti-idiotypic antibody.

In still another embodiment, the invention concerns an isolated polynucleotide that encodes a polypeptide of the present invention, wherein said polypeptide is capable of binding to both IL-17 and IL-23.

In still another embodiment, the invention concerns an isolated polypeptide of the present invention, wherein said polypeptide is capable of binding to both IL-17 and IL-23.

In yet another embodiment, the invention concerns a method for inhibiting IL-17 production and/or maintenance by treating the T cells with an antagonist of IL-23/p19 (IL-23).

In another aspect, the invention concerns a method for the treatment of an inflammatory disease characterized by elevated expression of IL-17 and IL-23 in a mammalian subject, comprising administering to the subject an effective amount of an antagonist of IL-17 and IL-[52] In yet another aspect, the invention concerns a method for identifying an anti-inflammatory agent comprising the steps of: (a) incubating a culture of T cells with IL-23, in the presence and absence of a candidate molecule; (b) monitoring the level of IL-17 in the culture; and (c) identifying the candidate molecule as an anti-inflammatory agent if the level of IL-17 is lower in the presence than in the absence of such candidate molecule.

Processes for producing the same are also herein described, wherein those processes comprise culturing a host cell comprising a vector which comprises the appropriate encoding nucleic acid molecule under conditions suitable for expression of said antibody and recovering said antibody from the cell culture.

In yet another embodiment, the present invention provides a composition comprising an IL-17/IL-23 antibody in admixture with a pharmaceutically acceptable carrier. In one aspect, the composition comprises a therapeutically effective amount of the antibody. Preferably, the composition is sterile. The composition may be administered in the form of a liquid pharmaceutical formulation, which may be preserved to achieve extended storage stability. Alternatively, the antibody is a monoclonal antibody, an antibody fragment, a humanized antibody, or a single-chain antibody.

In a further embodiment, the invention concerns an article of manufacture, comprising: (a) a composition of matter comprising an IL-17/IL-23 antibody, or an antibody that specifically binds to both IL-17 and IL-23 (via p19); (b) a container containing said composition; and (c) a label affixed to said container, or a package insert included in said container referring to the use of said IL-17/IL-23 antibody thereof in the treatment of an immune related disease. The composition may comprise a therapeutically effective amount of the IL-117/IL-23 antibody.

In yet another embodiment, the present invention concerns a method of diagnosing an immune related disease in a mammal, comprising detecting the level of expression of a gene encoding either or both IL-17 and/or IL-23 (a) in a test sample of tissue cells obtained from the mammal, and (b) in a control sample of known normal tissue cells of the same cell type, wherein a higher or lower expression level in the test sample as compared to the control sample indicates the presence of immune related disease in the mammal from which the test tissue cells were obtained.

In another embodiment, the present invention concerns a method of diagnosing an immune disease in a mammal, comprising (a) contacting an IL-17/IL-23 antibody with a test sample of tissue cells obtained from the mammal, and (b) detecting the formation of a complex between the antibody and either or both IL-17 and IL-23 in the test sample; wherein the formation of said complex is indicative of the presence or absence of said disease. The detection may be qualitative or quantitative, and may be performed in comparison with monitoring the complex formation in a control sample of known normal tissue cells of the same cell type. A larger quantity of complexes formed in the test sample indicates the presence or absence of an immune disease in the mammal from which the test tissue cells were obtained. The antibody preferably carries a detectable label. Complex formation can be monitored, for example, by light microscopy, flow cytometry, fluorimetry, or other techniques known in the art. The test sample is usually obtained from an individual suspected of having a deficiency or abnormality of the immune system.

In another embodiment, the invention provides a method of diagnosing an immune-related disease in a mammal which comprises detecting the presence or absence of both IL-17 and IL-23 in a test sample of tissue cells obtained from said mammal, wherein the presence or absence of both IL-17 and IL-23 in said test sample is indicative of the presence of an immune-related disease in said mammal.

In a still further embodiment, the invention provides a method of decreasing the activity of T-lymphocytes in a mammal comprising administering to said mammal an IL-17/IL-23 antagonist, such as an IL-17/IL-23p19 antibody, wherein the activity of T-lymphocytes in the mammal is decreased.

In a still further embodiment, the invention provides a method of decreasing the proliferation of T-lymphocytes in a mammal comprising administering to said mammal (a) an IL-17/IL-23 antagonist, such as an IL-17/IL-23p19 antibody, wherein the proliferation of T-lymphocytes in the mammal is decreased.

The invention also provides articles of manufacture and kits which include one or more IL-17, IL-23 or IL-17/IL-23 antibodies.

These and other aspects of the invention will become evident upon reference to the following detailed description. In addition, various references are identified below and are incorporated by reference in their entirety.

B) Definitions

In the description that follows, a number of terms are used extensively. The following definitions are provided to facilitate understanding of the invention.

"Antibodies" (Abs) and "immunoglobulins" (Igs) are glycoproteins having the same structural characteristics. While antibodies exhibit binding specificity to a specific antigen, immunoglobulins include both antibodies and other antibody-like molecules that lack antigen specificity. Polypeptides of the latter kind are, for example, produced at low levels by the lymph system and at increased levels by myelomas. Thus, as used herein, the term "antibody" or "antibody peptide(s)" refers to an intact antibody, or a binding fragment thereof that competes with the intact antibody for specific binding and includes chimeric, humanized, fully human, and bispecific antibodies. In certain embodiments, binding fragments are produced by recombinant DNA techniques. In additional embodiments, binding fragments are produced by enzymatic or chemical cleavage of intact antibodies. Binding fragments include, but are not limited to, Fab, Fab', F(ab).sub.2, F(ab').sub.2, Fv, and single-chain antibodies. "Native antibodies and immunoglobulins" are usually heterotetrameric glycoproteins of about 150,000 daltons, composed of two identical light (L) chains and two identical heavy (H) chains. Each light chain is linked to a heavy chain by one covalent disulfide bond, while the number of disulfide-linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain. Particular amino acid residues are believed to form an interface between the light- and heavy-chain variable domains (Clothia et al., *J. Mol. Biol.* 186:651 (1985); Novotny and Haber, *Proc. Natl. Acad. Sci. U.S.A.* 82:4592 (1985)).

The term "isolated antibody" as used herein refers to an antibody that has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

A "variant" anti-IL-17 and IL-23 antibody, and/or IL-17/IL-23 antibody, refers herein to a molecule which differs in amino acid sequence from a "parent" antibody amino acid sequence by virtue of addition, deletion and/or substitution of one or more amino acid residue(s) in the parent antibody sequence. In the preferred embodiment, the variant comprises one or more amino acid substitution(s) in one or more hypervariable region(s) of the parent antibody. For example, the variant may comprise at least one, e.g. from about one to about ten, and preferably from about two to about five, substitutions in one or more hypervariable regions of the parent antibody. Ordinarily, the variant will have an amino acid sequence having at least 75% amino acid sequence identity with the parent antibody heavy or light chain variable domain sequences, more preferably at least 80%, more preferably at least 85%, more preferably at least 90%, and most preferably at least 95%. Identity or homology with respect to this sequence is defined herein as the percentage of amino acid residues in the candidate sequence that are identical with the parent antibody residues, after aligning the sequences and introducing gaps, if necessary, to achieve the maximum percent sequence identity. None of N-terminal, C-terminal, or internal extensions, deletions, or insertions into the antibody sequence shall be construed as affecting sequence identity or homology. The variant retains the ability to bind human IL-17 and/or IL-23 (via p19) and preferably has properties which are superior to those of the parent antibody. For example, the variant may have a stronger binding affinity, enhanced ability to inhibit IL-17A and/or IL-23-induced inflammation. To analyze such properties, one should compare a Fab form of the variant to a Fab form of the parent antibody or a full length form of the variant to a full length form of the parent antibody, for example, since it has been found that the format of the anti-IL-17/IL-23 antibody impacts its activity in the biological activity assays disclosed herein. The variant antibody of particular interest herein is one which displays at least about 10-fold, preferably at least about 20-fold, and most preferably at least about 50-fold, enhancement in biological activity when compared to the parent antibody.

The term "parent antibody" as used herein refers to an antibody which is encoded by an amino acid sequence used for the preparation of the variant. Preferably, the parent antibody has a human framework region and, if present, has human antibody constant region(s). For example, the parent antibody may be a humanized or human antibody.

The term "agonist" refers to any compound including a protein, polypeptide, peptide, antibody, antibody fragment, large molecule, or small molecule (less than 10 kD), that increases the activity, activation or function of another molecule.

The term "antagonist" refers to any compound including a protein, polypeptide, peptide, antibody, antibody fragment, large molecule, or small molecule (less than 10 kD), that decreases the activity, activation or function of another molecule.

The term "bind(ing) of a polypeptide of the invention to a ligand" includes, but is not limited to, the binding of a ligand polypeptide of the present invention to a receptor; the binding of a receptor polypeptide of the present invention to a ligand; the binding of an antibody of the present invention to an antigen or epitope; the binding of an antigen or epitope of the present invention to an antibody; the binding of an antibody of the present invention to an anti-idiotypic antibody; the binding of an anti-idiotypic antibody of the present invention to a ligand; the binding of an anti-idiotypic antibody of the present invention to a receptor; the binding of an anti-anti-idiotypic antibody of the present invention to a ligand, receptor or antibody, etc.

A "bivalent antibody" other than a "multispecific" or "multifunctional" antibody, in certain embodiments, is understood to comprise binding sites having identical antigenic specificity.

A "bispecific" or "bifunctional" antibody is a hybrid antibody having two different heavy/light chain pairs and two different binding sites. Bispecific antibodies may be produced by a variety of methods including, but not limited to, fusion of hybridomas or linking of Fab' fragments. See, e.g., Songsivilai & Lachmann (1990), *Clin. Exp. Immunol.* 79:315-321; Kostelny et al. (1992), *J. Immunol.* 148:1547-1553.

The term "chimeric antibody" or "chimeric antibodies" refers to antibodies whose light and heavy chain genes have been constructed, typically by genetic engineering, from immunoglobulin variable and constant region genes belonging to different species. For example, the variable segments of the genes from a mouse monoclonal antibody may be joined to human constant segments, such as gamma 1 and gamma 3. A typical therapeutic chimeric antibody is thus a hybrid protein composed of the variable or antigen-binding domain from a mouse antibody and the constant domain from a human antibody, although other mammalian species may be used. Specifically, a chimeric antibody is produced by recombinant DNA technology in which all or part of the hinge and constant regions of an immunoglobulin light chain, heavy chain, or both, have been substituted for the corresponding regions from another animal's immunoglobulin light chain or heavy chain. In this way, the antigen-binding portion of the parent monoclonal antibody is grafted onto the backbone of another species' antibody. One approach, described in EP 0239400 to Winter et al. describes the substitution of one species' complementarity determining regions (CDRs) for those of another species, such as substituting the CDRs from human heavy and light chain immunoglobulin variable region domains with CDRs from mouse variable region domains. These altered antibodies may subsequently be combined with human immunoglobulin constant regions to form antibodies that are human except for the substituted murine CDRs which are specific for the antigen. Methods for grafting CDR regions of antibodies may be found, for example in Riechmann et al. (1988) *Nature* 332:323-327 and Verhoeyen et al. (1988) *Science* 239:1534-1536.

The term "effective neutralizing titer" as used herein refers to the amount of antibody which corresponds to the amount present in the serum of animals (human or cotton rat) that has been shown to be either clinically efficacious (in humans) or to reduce virus by 99% in, for example, cotton rats. The 99% reduction is defined by a specific challenge of, e.g., $10^3$ pfu, $10^4$ pfu, $10^5$ pfu, $10^6$ pfu, $10^7$ pfu, $10^8$ pfu, or $10^9$ pfu) of RSV.

As used herein, the term "epitope" refers to the portion of an antigen to which a monoclonal antibody specifically binds. Thus, the term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. More specifically, the term "IL-17 epitope", "IL-23 epitope" and/or "IL-23/p19 epitope" as used herein refers to a portion of the corresponding polypeptide having antigenic or immunogenic activity in an animal, preferably in a mammal, and most preferably in a mouse or a human. An epitope having immunogenic activity is a portion of an IL-17 and/or IL-23/p19 polypeptide that elicits an antibody response in an animal. An epitope having antigenic activity is a portion of an IL-17 and/or IL-23/p19 polypeptide to which an antibody immunospecifically binds as determined by any method well known in the art, for example, by immunoassays. Antigenic epitopes need not necessarily be immunogenic. Such epitopes can be linear in nature or can be a discontinuous epitope. Thus, as used herein, the term "conformational epitope" refers to a discontinuous epitope formed by a spatial relationship between amino acids of an antigen other than an unbroken series of amino acids.

The term "epitope tagged" when used herein refers to the anti-IL-17 and/or IL-23/p19 antibody fused to an "epitope tag". The epitope tag polypeptide has enough residues to provide an epitope against which an antibody can be made, yet is short enough such that it does not interfere with activity of antibodies of the present invention. The epitope tag preferably is sufficiently unique so that the antibody thereagainst does not substantially cross-react with other epitopes. Suitable tag polypeptides generally have at least 6 amino acid residues and usually between about 8-50 amino acid residues (preferably between about 9-30 residues). Examples include the flu HA tag polypeptide and its antibody 12CA5 (Field et al. *Mol. Cell. Biol.* 8:2159-2165 (1988)); the c-myc tag and the 8F9, 3C7, 6E10, G4, B7 and 9E10 antibodies thereto (Evan et al., *Mol. Cell. Biol.* 5(12):3610-3616 (1985)); and the Herpes Simplex virus glycoprotein D (gD) tag and its antibody (Paborsky et al., *Protein Engineering* 3(6):547-553 (1990)). In certain embodiments, the epitope tag is a "salvage receptor binding epitope". As used herein, the term "salvage receptor binding epitope" refers to an epitope of the Fc region of an IgG molecule (e.g., IgG.sub.1, IgG.sub.2, IgG.sub.3, or IgG.sub.4) that is responsible for increasing the in vivo serum half-life of the IgG molecule.

The term "fragment" as used herein refers to a peptide or polypeptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least contiguous 200 amino acid residues, or at least contiguous 250 amino acid residues of the amino acid sequence of a IL-17 or IL-23/p19 polypeptide or an antibody that immunospecifically binds to a either IL-17 or IL-23 (via p19) or both IL-17 and IL-23/p19 polypeptide.

As used herein, the term "immunoglobulin" refers to a protein consisting of one or more polypeptides substantially encoded by immunoglobulin genes. One form of immunoglobulin constitutes the basic structural unit of an antibody. This form is a tetramer and consists of two identical pairs of immunoglobulin chains, each pair having one light and one heavy chain. In each pair, the light and heavy chain variable regions are together responsible for binding to an antigen, and the constant regions are responsible for the antibody effector functions.

Full-length immunoglobulin "light chains" (about 25 Kd or 214 amino acids) are encoded by a variable region gene at the NH2-terminus (about 110 amino acids) and a kappa or lambda constant region gene at the COOH—terminus. Full-length immunoglobulin "heavy chains" (about 50 Kd or 446 amino acids), are similarly encoded by a variable region gene (about 116 amino acids) and one of the other aforementioned constant region genes (about 330 amino acids). Heavy chains are classified as gamma, mu, alpha, delta, or epsilon, and define the antibody's isotype as IgG, IgM, IgA, IgD and IgE, respectively. Within light and heavy chains, the variable and constant regions are joined by a "J" region of about 12 or more amino acids, with the heavy chain also including a "D" region of about 10 more amino acids. (See generally, Fundamental Immunology (Paul, W., ed., 2nd ed. Raven Press, N.Y., 1989), Ch. 7 (incorporated by reference in its entirety for all purposes).

An immunoglobulin light or heavy chain variable region consists of a "framework" region interrupted by three hypervariable regions. Thus, the term "hypervariable region" refers to the amino acid residues of an antibody which are responsible for antigen binding. The hypervariable region comprises amino acid residues from a "Complementarity Determining Region" or "CDR" (i.e., residues 24-34 (L1), 50-56 (L2) and 89-97 (L3) in the light chain variable domain and 31-35 (H1), 50-65 (H2) and 95-102 (H3) in the heavy chain variable domain (Kabat et al., Sequences of Proteins of Immunological Interest, 5th Ed. Public Health Service, National Institutes of Health, Bethesda, Md. (1991)) and/or those residues from a "hypervariable loop" (i.e., residues 26-32 (L1), 50-52 (L2) and 91-96 (L3) in the light chain variable domain and 26-32 (H1), 53-55 (H2) and 96-101 (H3) in the heavy chain variable domain; Chothia and Lesk, 1987, *J. Mol. Biol* 196: 901-917) (both of which are incorporated herein by reference). "Framework Region" or "FR" residues are those variable domain residues other than the hypervariable region residues as herein defined. The sequences of the framework regions of different light or heavy chains are relatively conserved within a species. Thus, a "human framework region" is a framework region that is substantially identical (about 85% or more, usually 90-95% or more) to the framework region of a naturally occurring human immunoglobulin. The framework region of an antibody, that is the combined framework regions of the constituent light and heavy chains, serves to position and align the CDR's. The CDR's are primarily responsible for binding to an epitope of an antigen.

Accordingly, the term "humanized" immunoglobulin refers to an immunoglobulin comprising a human framework region and one or more CDR's from a non-human (usually a mouse or rat) immunoglobulin. The non-human immunoglobulin providing the CDR's is called the "donor" and the human immunoglobulin providing the framework is called the "acceptor". Constant regions need not be present, but if they are, they must be substantially identical to human immunoglobulin constant regions, i.e., at least about 85-90%, preferably about 95% or more identical. Hence, all parts of a humanized immunoglobulin, except possibly the CDR's, are substantially identical to corresponding parts of natural human immunoglobulin sequences. A "humanized antibody" is an antibody comprising a humanized light chain and a humanized heavy chain immunoglobulin. For example, a humanized antibody would not encompass a typical chimeric antibody as defined above, e.g., because the entire variable region of a chimeric antibody is non-human.

As used herein, the term "human antibody" includes and antibody that has an amino acid sequence of a human immunoglobulin and includes antibodies isolated from human immunoglobulin libraries or from animals transgenic for one or more human immunoglobulin and that do not express endogenous immunoglobulins, as described, for example, by Kucherlapati et al in U.S. Pat. No. 5,939,598.

The term "genetically altered antibodies" means antibodies wherein the amino acid sequence has been varied from that of a native antibody. Because of the relevance of recombinant DNA techniques in the generation of antibodies, one need not be confined to the sequences of amino acids found in natural antibodies; antibodies can be redesigned to obtain desired characteristics. The possible variations are many and range from the changing of just one or a few amino acids to the complete redesign of, for example, the variable or constant region. Changes in the constant region will, in general, be made in order to improve or alter characteristics, such as complement fixation, interaction with membranes and other effector functions. Changes in the variable region will be made in order to improve the antigen binding characteristics.

In addition to antibodies, immunoglobulins may exist in a variety of other forms including, for example, single-chain or Fv, Fab, and (Fab').sub.2, as well as diabodies, linear antibodies, multivalent or multispecific hybrid antibodies (as described above and in detail in: Lanzavecchia et al., *Eur. J. Immunol.* 17, 105 (1987)) and in single chains (e.g., Huston et al., *Proc. Natl. Acad. Sci. U.S.A.*, 85, 5879-5883 (1988) and Bird et al., *Science,* 242, 423-426 (1988), which are incorporated herein by reference). (See, generally, Hood et al., "Immunology", Benjamin, N.Y., 2nd ed. (1984), and Hunkapiller and Hood, *Nature,* 323, 15-16 (1986), which are incorporated herein by reference).

As used herein, the terms "single-chain Fv," "single-chain antibodies," "Fv" or "scFv" refer to antibody fragments that comprises the variable regions from both the heavy and light chains, but lacks the constant regions, but within a single polypeptide chain. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) *Science* 242:423-442; Huston et al. (1988) *Proc. Natl. Acad. Sci. USA* 85:5879-5883; Ward et al. (1989) *Nature* 334:54454; Skerra et al. (1988) *Science* 242:1038-1041, the disclosures of which are incorporated by reference for any purpose. In specific embodiments, single-chain antibodies can also be bi-specific and/or humanized.

A "Fab fragment" is comprised of one light chain and the $C_H1$ and variable regions of one heavy chain. The heavy chain of a Fab molecule cannot form a disulfide bond with another heavy chain molecule.

A "Fab' fragment" contains one light chain and one heavy chain that contains more of the constant region, between the $C_H1$ and $C_H2$ domains, such that an interchain disulfide bond can be formed between two heavy chains to form a $F(ab')_2$ molecule.

A "$F(ab')_2$ fragment" contains two light chains and two heavy chains containing a portion of the constant region between the $C_H1$ and $C_H2$ domains, such that an interchain disulfide bond is formed between two heavy chains.

The term "diabodies" refers to small antibody fragments with two antigen-binding sites, which fragments comprise a heavy chain variable domain ($V_H$) connected to a light chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA* 90:6444-6448 (1993).

The term "linear antibodies" refers to the antibodies described in Zapata et al. *Protein Eng.* 8(10):1057-1062 (1995). Briefly, these antibodies comprise a pair of tandem Fd segments ($V_H$-$C_{H1}$-$V_H$-$C_{H1}$) which form a pair of antigen binding regions. Linear antibodies can be bispecific or monospecific.

The term "immunologically functional immunoglobulin fragment" as used herein refers to a polypeptide fragment that contains at least the variable domains of the immunoglobulin heavy and light chains. An immunologically functional immunoglobulin fragment of the invention is capable of binding to a ligand, preventing binding of the ligand to its receptor, interrupting the biological response resulting from ligand binding to the receptor, or any combination thereof. Preferably, an immunologically functional immunoglobulin fragment of the invention binds specifically to either IL-17 or IL-23/p19 or to both IL-17 and IL-23/p19.

The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

As used herein, "nucleic acid" or "nucleic acid molecule" refers to polynucleotides, such as deoxyribonucleic acid (DNA) or ribonucleic acid (RNA), oligonucleotides, fragments generated by the polymerase chain reaction (PCR), and fragments generated by any of ligation, scission, endonuclease action, and exonuclease action. Nucleic acid molecules can be composed of monomers that are naturally-occurring nucleotides (such as DNA and RNA), or analogs of naturally-occurring nucleotides (e.g., α-enantiomeric forms of naturally-occurring nucleotides), or a combination of both. Modified nucleotides can have alterations in sugar moieties and/or in pyrimidine or purine base moieties. Sugar modifications include, for example, replacement of one or more hydroxyl groups with halogens, alkyl groups, amines, and azido groups, or sugars can be functionalized as ethers or esters. Moreover, the entire sugar moiety can be replaced with sterically and electronically similar structures, such as aza-sugars and carbocyclic sugar analogs. Examples of modifications in a base moiety include alkylated purines and pyrimidines, acylated purines or pyrimidines, or other well-known heterocyclic substitutes. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, and the like. The term "nucleic acid molecule" also includes so-called "peptide nucleic acids," which comprise naturally-occurring or modified nucleic acid bases attached to a polyamide backbone. Nucleic acids can be either single stranded or double stranded.

The term "complement of a nucleic acid molecule" refers to a nucleic acid molecule having a complementary nucleotide sequence and reverse orientation as compared to a reference nucleotide sequence. For example, the sequence 5' ATGCACGGG 3' is complementary to 5' CCCGTGCAT 3'.

The term "degenerate nucleotide sequence" denotes a sequence of nucleotides that includes one or more degenerate codons as compared to a reference nucleic acid molecule that encodes a polypeptide. Degenerate codons contain different triplets of nucleotides, but encode the same amino acid residue (i.e., GAU and GAC triplets each encode Asp).

The term "structural gene" refers to a nucleic acid molecule that is transcribed into messenger RNA (mRNA), which is then translated into a sequence of amino acids characteristic of a specific polypeptide.

An "isolated nucleic acid molecule" is a nucleic acid molecule that is not integrated in the genomic DNA of an organism. For example, a DNA molecule that encodes a growth factor that has been separated from the genomic DNA of a cell is an isolated DNA molecule. Another example of an isolated nucleic acid molecule is a chemically-synthesized nucleic acid molecule that is not integrated in the genome of an organism. A nucleic acid molecule that has been isolated from a particular species is smaller than the complete DNA molecule of a chromosome from that species.

A "nucleic acid molecule construct" is a nucleic acid molecule, either single- or double-stranded, that has been modified through human intervention to contain segments of nucleic acid combined and juxtaposed in an arrangement not existing in nature.

"Linear DNA" denotes non-circular DNA molecules having free 5' and 3' ends. Linear DNA can be prepared from closed circular DNA molecules, such as plasmids, by enzymatic digestion or physical disruption.

"Complementary DNA (cDNA)" is a single-stranded DNA molecule that is formed from an mRNA template by the enzyme reverse transcriptase. Typically, a primer complementary to portions of mRNA is employed for the initiation of reverse transcription. Those skilled in the art also use the term "cDNA" to refer to a double-stranded DNA molecule consisting of such a single-stranded DNA molecule and its complementary DNA strand. The term "cDNA" also refers to a clone of a cDNA molecule synthesized from an RNA template.

A "promoter" is a nucleotide sequence that directs the transcription of a structural gene. Typically, a promoter is located in the 5' non-coding region of a gene, proximal to the transcriptional start site of a structural gene. Sequence elements within promoters that function in the initiation of transcription are often characterized by consensus nucleotide sequences. These promoter elements include RNA polymerase binding sites, TATA sequences, CAAT sequences, differentiation-specific elements (DSEs; McGehee et al., *Mol. Endocrinol* 7:551 (1993)), cyclic AMP response elements (CREs), serum response elements (SREs; Treisman, *Seminars in Cancer Biol.* 1.47 (1990)), glucocorticoid response elements (GREs), and binding sites for other transcription factors, such as CRE/ATF (O'Reilly et al., *J. Biol. Chem.* 267:19938 (1992)), AP2 (Ye et al., *J. Biol. Chem.* 269:25728 (1994)), SPI, cAMP response element binding protein (CREB; Loeken, *Gene Expr.* 3:253 (1993)) and octamer factors (see, in general, Watson et al., eds., *Molecular Biology of the Gene,* 4th ed. (The Benjamin/Cummings Publishing Company, Inc. 1987), and Lemaigre and Rousseau, *Biochem. J.* 303:1 (1994)). If a promoter is an inducible promoter, then the rate of transcription increases in response to an inducing agent. In contrast, the rate of transcription is not regulated by an inducing agent if the promoter is a constitutive promoter. Repressible promoters are also known.

A "core promoter" contains essential nucleotide sequences for promoter function, including the TATA box and start of transcription. By this definition, a core promoter may or may not have detectable activity in the absence of specific sequences that may enhance the activity or confer tissue specific activity.

A "regulatory element" is a nucleotide sequence that modulates the activity of a core promoter. For example, a regulatory element may contain a nucleotide sequence that binds with cellular factors enabling transcription exclusively or preferentially in particular cells, tissues, or organelles. These types of regulatory elements are normally associated with genes that are expressed in a "cell-specific," "tissue-specific," or "organelle-specific" manner.

An "enhancer" is a type of regulatory element that can increase the efficiency of transcription, regardless of the distance or orientation of the enhancer relative to the start site of transcription.

"Heterologous DNA" refers to a DNA molecule, or a population of DNA molecules, that does not exist naturally within a given host cell. DNA molecules heterologous to a particular host cell may contain DNA derived from the host cell species (i.e., endogenous DNA) so long as that host DNA is combined with non-host DNA (i.e., exogenous DNA). For example, a DNA molecule containing a non-host DNA segment encoding a polypeptide operably linked to a host DNA segment comprising a transcription promoter is considered to be a heterologous DNA molecule. Conversely, a heterologous DNA molecule can comprise an endogenous gene operably linked with an exogenous promoter. As another illustration, a DNA molecule comprising a gene derived from a wild-type cell is considered to be heterologous DNA if that DNA molecule is introduced into a mutant cell that lacks the wild-type gene.

A "polypeptide" is a polymer of amino acid residues joined by peptide bonds, whether produced naturally or synthetically. Polypeptides of less than about 10 amino acid residues are commonly referred to as "peptides."

A "protein" is a macromolecule comprising one or more polypeptide chains. A protein may also comprise non-peptidic components, such as carbohydrate groups. Carbohydrates and other non-peptidic substituents may be added to a protein by the cell in which the protein is produced, and will vary with the type of cell. Proteins are defined herein in terms of their amino acid backbone structures; substituents such as carbohydrate groups are generally not specified, but may be present nonetheless.

A peptide or polypeptide encoded by a non-host DNA molecule is a "heterologous" peptide or polypeptide.

A "cloning vector" is a nucleic acid molecule, such as a plasmid, cosmid, or bacteriophage, that has the capability of replicating autonomously in a host cell. Cloning vectors typically contain one or a small number of restriction endonuclease recognition sites that allow insertion of a nucleic acid molecule in a determinable fashion without loss of an essential biological function of the vector, as well as nucleotide sequences encoding a marker gene that is suitable for use in the identification and selection of cells transformed with the cloning vector. Marker genes typically include genes that provide tetracycline resistance or ampicillin resistance.

An "expression vector" is a nucleic acid molecule encoding a gene that is expressed in a host cell. Typically, an expression vector comprises a transcription promoter, a gene, and a transcription terminator. Gene expression is usually placed under the control of a promoter, and such a gene is said to be "operably linked to" the promoter. Similarly, a regulatory element and a core promoter are operably linked if the regulatory element modulates the activity of the core promoter.

A "recombinant host" is a cell that contains a heterologous nucleic acid molecule, such as a cloning vector or expression vector. In the present context, an example of a recombinant host is a cell that produces an antagonist of the present invention from an expression vector. In contrast, such an antagonist can be produced by a cell that is a "natural source" of said antagonist, and that lacks an expression vector.

"Integrative transformants" are recombinant host cells, in which heterologous DNA has become integrated into the genomic DNA of the cells.

A "fusion protein" is a hybrid protein expressed by a nucleic acid molecule comprising nucleotide sequences of at least two genes. For example, a fusion protein can comprise at least part of a IL-17RA polypeptide fused with a polypeptide that binds an affinity matrix. Such a fusion protein provides a means to isolate large quantities of IL-17RA using affinity chromatography.

The term "receptor" denotes a cell-associated protein that binds to a bioactive molecule termed a "ligand." This interaction mediates the effect of the ligand on the cell. Receptors can be membrane bound, cytosolic or nuclear; monomeric (e.g., thyroid stimulating hormone receptor, beta-adrenergic receptor) or multimeric (e.g., PDGF receptor, growth hormone receptor, IL-3 receptor, GM-CSF receptor, G-CSF receptor, erythropoietin receptor and IL-6 receptor). Membrane-bound receptors are characterized by a multi-domain structure comprising an extracellular ligand-binding domain and an intracellular effector domain that is typically involved in signal transduction. In certain membrane-bound receptors, the extracellular ligand-binding domain and the intracellular effector domain are located in separate polypeptides that comprise the complete functional receptor.

In general, the binding of ligand to receptor results in a conformational change in the receptor that causes an interaction between the effector domain and other molecule(s) in the cell, which in turn leads to an alteration in the metabolism of the cell. Metabolic events that are often linked to receptor-ligand interactions include gene transcription, phosphorylation, dephosphorylation, increases in cyclic AMP production, mobilization of cellular calcium, mobilization of membrane lipids, cell adhesion, hydrolysis of inositol lipids and hydrolysis of phospholipids.

The term "secretory signal sequence" denotes a DNA sequence that encodes a peptide (a "secretory peptide") that, as a component of a larger polypeptide, directs the larger polypeptide through a secretory pathway of a cell in which it is synthesized. The larger polypeptide is commonly cleaved to remove the secretory peptide during transit through the secretory pathway.

An "isolated polypeptide" is a polypeptide that is essentially free from contaminating cellular components, such as carbohydrate, lipid, or other proteinaceous impurities associated with the polypeptide in nature. Typically, a preparation of isolated polypeptide contains the polypeptide in a highly purified form, i.e., at least about 80% pure, at least about 90% pure, at least about 95% pure, greater than 95% pure, such as 96%, 97%, or 98% or more pure, or greater than 99% pure. One way to show that a particular protein preparation contains an isolated polypeptide is by the appearance of a single band following sodium dodecyl sulfate (SDS)-polyacrylamide gel electrophoresis of the protein preparation and Coomassie Brilliant Blue staining of the gel. However, the term "isolated" does not exclude the presence of the same polypeptide in alternative physical forms, such as dimers or alternatively glycosylated or derivatized forms.

The terms "amino-terminal" and "carboxyl-terminal" are used herein to denote positions within polypeptides. Where the context allows, these terms are used with reference to a particular sequence or portion of a polypeptide to denote proximity or relative position. For example, a certain sequence positioned carboxyl-terminal to a reference sequence within a polypeptide is located proximal to the carboxyl terminus of the reference sequence, but is not necessarily at the carboxyl terminus of the complete polypeptide.

The term "expression" refers to the biosynthesis of a gene product. For example, in the case of a structural gene, expression involves transcription of the structural gene into mRNA and the translation of mRNA into one or more polypeptides.

As used herein, the term "immunomodulator" includes cytokines, stem cell growth factors, lymphotoxins, co-stimulatory molecules, hematopoietic factors, and the like, and synthetic analogs of these molecules.

The term "complement/anti-complement pair" denotes non-identical moieties that form a non-covalently associated, stable pair under appropriate conditions. For instance, biotin and avidin (or streptavidin) are prototypical members of a complement/anti-complement pair. Other exemplary complement/anti-complement pairs include receptor/ligand pairs, antibody/antigen (or hapten or epitope) pairs, sense/antisense polynucleotide pairs, and the like. Where subsequent dissociation of the complement/anti-complement pair is desirable, the complement/anti-complement pair preferably has a binding affinity of less than $10^9$ $M^{-1}$.

As used herein, a "therapeutic agent" is a molecule or atom which is conjugated to an antibody moiety to produce a conjugate which is useful for therapy. Examples of therapeutic agents include drugs, toxins, immunomodulators, chelators, boron compounds, photoactive agents or dyes, and radioisotopes.

A "detectable label" is a molecule or atom which can be conjugated to an antibody moiety to produce a molecule useful for diagnosis. Examples of detectable labels include chelators, photoactive agents, radioisotopes, fluorescent agents, paramagnetic ions, or other marker moieties.

The term "affinity tag" is used herein to denote a polypeptide segment that can be attached to a second polypeptide to provide for purification or detection of the second polypeptide or provide sites for attachment of the second polypeptide to a substrate. In principal, any peptide or protein for which an antibody or other specific binding agent is available can be used as an affinity tag. Affinity tags include a poly-histidine tract, protein A (Nilsson et al., *EMBO J.* 4:1075 (1985); Nilsson et al., *Methods Enzymol* 198:3 (1991)), glutathione S transferase (Smith and Johnson, *Gene* 67:31 (1988)), Glu-Glu affinity tag (Grussenmeyer et al., *Proc. Natl. Acad. Sci. USA* 82:7952 (1985)), substance P, FLAG peptide (Hopp et al., *Biotechnology* 6:1204 (1988)), streptavidin binding peptide, or other antigenic epitope or binding domain. See, in general, Ford et al., *Protein Expression and Purification* 2:95 (1991). DNA molecules encoding affinity tags are available from commercial suppliers (e.g., Pharmacia Biotech, Piscataway, N.J.).

A "target polypeptide" or a "target peptide" is an amino acid sequence that comprises at least one epitope, and that is expressed on a target cell, such as a tumor cell, or a cell that carries an infectious agent antigen. T cells recognize peptide epitopes presented by a major histocompatibility complex molecule to a target polypeptide or target peptide and typically lyse the target cell or recruit other immune cells to the site of the target cell, thereby killing the target cell.

In eukaryotes, RNA polymerase II catalyzes the transcription of a structural gene to produce mRNA. A nucleic acid molecule can be designed to contain an RNA polymerase II template in which the RNA transcript has a sequence that is complementary to that of a specific mRNA. The RNA transcript is termed an "anti-sense RNA" and a nucleic acid molecule that encodes the anti-sense RNA is termed an "anti-sense gene." Anti-sense RNA molecules are capable of binding to mRNA molecules, resulting in an inhibition of mRNA translation.

An "anti-sense oligonucleotide specific for IL-17A or IL-23" is an oligonucleotide having a sequence (a) capable of forming a stable triplex with a portion of the IL-17A or IL-23 gene, or (b) capable of forming a stable duplex with a portion of an mRNA transcript of the IL-17A or IL-23 gene.

A "ribozyme" is a nucleic acid molecule that contains a catalytic center. The term includes RNA enzymes, self-splicing RNAs, self-cleaving RNAs, and nucleic acid molecules that perform these catalytic functions. A nucleic acid molecule that encodes a ribozyme is termed a "ribozyme gene."

An "external guide sequence" is a nucleic acid molecule that directs the endogenous ribozyme, RNase P, to a particular species of intracellular mRNA, resulting in the cleavage of the mRNA by RNase P. A nucleic acid molecule that encodes an external guide sequence is termed an "external guide sequence gene."

The term "allelic variant" is used herein to denote any of two or more alternative forms of a gene occupying the same chromosomal locus. Allelic variation arises naturally through mutation, and may result in phenotypic polymorphism within populations. Gene mutations can be silent (no change in the encoded polypeptide) or may encode polypeptides having altered amino acid sequence. The term allelic variant is also used herein to denote a protein encoded by an allelic variant of a gene.

The term "ortholog" denotes a polypeptide or protein obtained from one species that is the functional counterpart of a polypeptide or protein from a different species. Sequence differences among orthologs are the result of speciation.

"Paralogs" are distinct but structurally related proteins made by an organism. Paralogs are believed to arise through gene duplication. For example, α-globin, β-globin, and myoglobin are paralogs of each other.

Due to the imprecision of standard analytical methods, molecular weights and lengths of polymers are understood to be approximate values. When such a value is expressed as "about" X or "approximately" X, the stated value of X will be understood to be accurate to ±10%.

C) Antibodies that Bind IL-17 and IL-23 (via p19)

The antibodies of the invention specifically bind to IL-17 and IL-23 (via p19). In some embodiments, the antibodies of the invention specifically bind a monomeric form of both IL-17 and IL-23. In some embodiments, the antibodies of the invention bind a homodimeric form of either IL-17 or IL-23. In still other embodiments, the antibodies of the invention specifically bind a multimeric form of IL-17 or IL-23 (e.g., a heterodimeric form). For instance, IL-17 can form a heterodimer with any other member of the IL-17 family of ligands, such as IL-17B, IL-17C, or IL-17F. Preferred antibodies of the invention block the biological activities of IL-17 and IL-23, either singly or together.

Preferred antibodies, and antibodies suitable for use in the method of the invention, include, for example, fully human antibodies, human antibody homologs, humanized antibody homologs, chimeric antibody homologs, Fab, Fab', F(ab) .sub.2, F(ab').sub.2 and F(v) antibody fragments, single chain antibodies, and monomers or dimers of antibody heavy or light chains or mixtures thereof. Antibodies of the invention are preferably monoclonal antibodies.

The antibodies of the invention may include intact immunoglobulins of any isotype including types IgA, IgG, IgE, IgD, IgM (as well as subtypes thereof). The antibodies preferably include intact IgG and more preferably IgG1. The light chains of the immunoglobulin may be kappa or lambda. The light chains are preferably kappa.

The antibodies of the invention comprise or consist of portions of intact antibodies that retain antigen-binding specificity, for example, Fab fragments, Fab' fragments, F(ab') .sub.2 fragments, F(v) fragments, heavy chain monomers or dimers, light chain monomers or dimers, dimers consisting of one heavy and one light chain, and the like. Thus, antigen binding fragments, as well as full-length dimeric or trimeric polypeptides derived from the above-described antibodies are themselves useful.

The direct use of rodent monoclonal antibodies (MAbs) as human therapeutic agents led to human anti-rodent antibody ("HARA") (for example, human anti-mouse antibody ("HAMA")) responses which occurred in a significant number of patients treated with the rodent-derived antibody (Khazaeli, et al., (1994) *Immunother.* 15:42-52). Chimeric antibodies containing fewer murine amino acid sequences are believed to circumvent the problem of eliciting an immune response in humans.

Refinement of antibodies to avoid the problem of HARA responses led to the development of "humanized antibodies." Humanized antibodies are produced by recombinant DNA technology, in which at least one of the amino acids of a human immunoglobulin light or heavy chain that is not required for antigen binding has been substituted for the corresponding amino acid from a nonhuman mammalian immunoglobulin light or heavy chain. For example, if the immunoglobulin is a mouse monoclonal antibody, at least one amino acid that is not required for antigen binding is substituted using the amino acid that is present on a corresponding human antibody in that position. Without wishing to be bound by any particular theory of operation, it is believed that the "humanization" of the monoclonal antibody inhibits human immunological reactivity against the foreign immunoglobulin molecule.

As a non-limiting example, a method of performing complementarity determining region (CDR) grafting may be performed by sequencing the mouse heavy and light chains of the antibody of interest that binds to the target antigen (e.g., IL-17 and/or IL-23/p19) and genetically engineering the CDR DNA sequences and imposing these amino acid sequences to corresponding human V regions by site directed mutagenesis. Human constant region gene segments of the desired isotype are added, and the "humanized" heavy and light chain genes are co-expressed in mammalian cells to produce soluble humanized antibody. A typical expression cell is a Chinese Hamster Ovary (CHO) cell. Suitable methods for creating the chimeric antibodies may be found, for example, in Jones et al. (1986) *Nature* 321:522-525; Riechmann (1988) *Nature* 332:323-327; Queen et al. (1989) *Proc. Nat. Acad. Sci. USA* 86:10029; and Orlandi et al. (1989) *Proc. Natl. Acad. Sci. USA* 86:3833.

Queen et al. (1989) *Proc. Nat. Acad. Sci. USA* 86:10029-10033 and WO 90/07861 describe the preparation of a humanized antibody. Human and mouse variable framework regions were chosen for optimal protein sequence homology. The tertiary structure of the murine variable region was computer-modeled and superimposed on the homologous human framework to show optimal interaction of amino acid residues with the mouse CDRs. This led to the development of antibodies with improved binding affinity for antigen (which is typically decreased upon making CDR-grafted chimeric antibodies). Alternative approaches to making humanized antibodies are known in the art and are described, for example, in Tempest (1991) *Biotechnology* 9:266-271.

The antibodies of the invention may be used alone or as immunoconjugates with a cytotoxic agent. In some embodiments, the agent is a chemotherapeutic agent. In some embodiments, the agent is a radioisotope, including, but not limited to Lead-212, Bismuth-212, Astatine-211, Iodine-131, Scandium-47, Rhenium-186, Rhenium-188, Yttrium-90, Iodine-123, Iodine-125, Bromine-77, Indium-111, and fissionable nuclides such as Boron-10 or an Actinide. In other embodiments, the agent is a toxin or cytotoxic drug, including but not limited to ricin, modified *Pseudomonas* enterotoxin A, calicheamicin, adriamycin, 5-fluorouracil, and the like. Methods of conjugation of antibodies and antibody fragments to such agents are known in the literature.

The antibodies of the invention include derivatives that are modified, e.g., by the covalent attachment of any type of molecule to the antibody such that covalent attachment does not prevent the antibody from binding to its epitope. Examples of suitable derivatives include, but are not limited to fucosylated antibodies and fragments, glycosylated antibodies and fragments, acetylated antibodies and fragments, pegylated antibodies and fragments, phosphorylated antibodies and fragments, and amidated antibodies and fragments. The antibodies and derivatives thereof of the invention may themselves by derivatized by known protecting/blocking groups, proteolytic cleavage, linkage to a cellular ligand or other proteins, and the like. In some embodiments of the invention, at least one heavy chain of the antibody is fucosylated. In some embodiments, the fucosylation is N-linked. In some preferred embodiments, at least one heavy chain of the antibody comprises a fucosylated, N-linked oligosaccharide.

The antibodies of the invention include variants having single or multiple amino acid substitutions, deletions, additions, or replacements that retain the biological properties (e.g., block the binding of IL-17 and/or IL-23 to their respective receptors, block the biological activity of IL-17 and IL-23, binding affinity) of the antibodies of the invention. The skilled person can produce variants having single or multiple amino acid substitutions, deletions, additions or replacements. These variants may include, inter alia: (a) variants in which one or more amino acid residues are substituted with conservative or nonconservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Antibodies of the invention may include variants in which amino acid residues from one species are substituted for the corresponding residue in another species, either at the conserved or nonconserved positions. In another embodiment, amino acid residues at nonconserved positions are substituted with conservative or nonconservative residues. The techniques for obtaining these variants, including genetic (suppressions, deletions, mutations, etc.), chemical, and enzymatic techniques, are known to the person having ordinary skill in the art. Antibodies of the invention also include antibody fragments. A "fragment" refers to polypeptide sequences which are at least about 40, at least to about 50, at least about 60, at least about 70, at least about 80, at least about 90, and at least about 100 amino acids in length, and which retain some biological activity or immunological activity of the full-length sequence, such as, for example, the ability to block the binding of IL-17 and/or IL-23 to their respective receptors, block the biological activity of IL-17 and IL-23, and affect binding affinity.

The invention also encompasses fully human antibodies such as those derived from peripheral blood mononuclear cells of ovarian, breast, renal, colorectal, lung, endometrial, or brain cancer patients. Such cells may be fused with myeloma cells, for example, to form hybridoma cells producing fully human antibodies against both IL-17 and IL-23/p19.

The invention also encompasses bispecific antibodies that bind to both IL-17 and IL-23 (via p19).

Antibodies that bind to IL-17A and IL-23p19 have been identified by screening a phage display library. Methods of screening by phage display are described in detail in standard reference texts, such as Babas, *Phage Display: A Laboratory Manual* Cold Spring Harbor Lab Press, 2001 and Lo, Benny K. C., A., *Antibody Engineering,* 2004. Such phage display libraries can be used to display expressed proteins on the surface of a cell or other substance such that the complementary binding entity can be functionally isolated. In one such phage display library, the antibody light-chain variable region and a portion of the heavy-chain variable region are combined with synthetic DNA encoding human antibody sequences, which are then displayed on phage and phagemid libraries as Fab antibody fragments (Dyax® Human Antibody Libraries, Dyax Corp., Cambridge, Mass.). Thus, the variable light and heavy chain fragments of antibodies can be isolated in a Fab format. These variable regions can then be manipulated to generate antibodies, including antigen-binding fragments, such as scFvs, bispecific scFvs and multispecific, multifunctional antagonists to IL-17A or IL-23p19.

Using this technology the variable regions of Fabs have been identified for their charactaristics of binding and or neutralizing either IL-17A or IL-23p19 in the plate-based assays described in Examples 15 through 18 herein. These variable regions were manipulated to generate various binding entities, including scFvs that bind and/or neutralize IL-17A or IL-23p19.

Table 1 below shows a list of the Fabs or scFvs that bind IL-17A.

TABLE 1

| Cluster # | VL nucleotide SEQ ID NO: | VH nucleotide SEQ ID NO: | VL polypeptide SEQ ID NO: | VH polypeptide SEQ ID NO: | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|---|---|---|---|
| 83 | 78 | 79 | 80 | 81 | 1-22 | 23-33 | 34-48 | 49-55 | 56-87 | 88-96 | 97-106 | 1-30 | 31-35 | 36-49 | 50-66 | 67-98 | 99-116 | 117-127 |
| 84 | 82 | 83 | 84 | 85 | 1-22 | 23-35 | 36-50 | 51-57 | 58-89 | 90-100 | 101-110 | 1-30 | 31-35 | 36-49 | 50-66 | 67-98 | 99-118 | 119-129 |
| 85 | 86 | 87 | 88 | 89 | 1-23 | 24-34 | 35-49 | 50-56 | 57-88 | 89-97 | 98-107 | 1-30 | 31-35 | 36-49 | 50-67 | 68-98 | 100-115 | 116-126 |
| 86 | 90 | 91 | 92 | 93 | 1-23 | 24-34 | 35-49 | 50-56 | 57-88 | 89-97 | 98-107 | 1-30 | 31-35 | 36-49 | 50-66 | 67-98 | 99-113 | 114-124 |
| 87 | 94 | 95 | 96 | 97 | 1-23 | 24-34 | 35-49 | 50-56 | 57-88 | 89-97 | 98-107 | 1-30 | 31-35 | 36-49 | 50-66 | 67-98 | 99-108 | 109-119 |
| 88 | 98 | 99 | 100 | 101 | 1-23 | 24-34 | 35-49 | 50-56 | 57-88 | 89-97 | 98-107 | 1-30 | 31-35 | 36-49 | 50-66 | 67-98 | 99-114 | 115-125 |
| 89 | 102 | 103 | 104 | 105 | 1-22 | 23-33 | 34-48 | 49-55 | 56-87 | 88-96 | 97-106 | 1-30 | 31-35 | 36-49 | 50-66 | 67-98 | 99-114 | 115-125 |
| 90 | 106 | 107 | 108 | 109 | 1-23 | 24-34 | 35-49 | 50-56 | 57-88 | 89-97 | 98-107 | 1-30 | 31-35 | 36-49 | 50-66 | 67-98 | 99-112 | 113-123 |
| 91 | 110 | 111 | 112 | 113 | 1-23 | 24-34 | 35-49 | 50-56 | 57-88 | 89-97 | 98-107 | 1-30 | 31-35 | 36-49 | 50-66 | 67-98 | 99-112 | 113-123 |
| 92 | 114 | 115 | 116 | 117 | 1-23 | 24-34 | 35-49 | 50-56 | 57-88 | 89-97 | 98-107 | 1-30 | 31-35 | 36-49 | 50-66 | 67-98 | 99-114 | 115-125 |
| 93 | 118 | 119 | 120 | 121 | 1-23 | 24-34 | 35-49 | 50-56 | 57-88 | 89-97 | 98-107 | 1-30 | 31-35 | 36-49 | 50-66 | 67-98 | 99-103 | 104-114 |
| 94 | 122 | 123 | 124 | 125 | 1-23 | 24-39 | 40-54 | 55-61 | 62-93 | 94-103 | 104-113 | 1-30 | 31-35 | 36-49 | 50-66 | 67-98 | 99-107 | 108-118 |
| 95 | 126 | 127 | 128 | 129 | 1-23 | 24-34 | 35-49 | 50-56 | 57-88 | 89-97 | 98-107 | 1-30 | 31-35 | 36-49 | 50-66 | 67-98 | 99-105 | 106-116 |
| 96 | 130 | 131 | 132 | 133 | 1-23 | 24-34 | 35-49 | 50-56 | 57-88 | 89-97 | 98-107 | 1-30 | 31-35 | 36-49 | 50-66 | 67-98 | 99-114 | 115-125 |
| 97 | 134 | 135 | 136 | 137 | 1-23 | 24-34 | 35-49 | 50-56 | 57-88 | 89-97 | 98-107 | 1-30 | 31-35 | 36-49 | 50-66 | 67-98 | 99-105 | 106-116 |
| 98 | 138 | 139 | 140 | 141 | 1-23 | 24-34 | 35-49 | 50-56 | 57-88 | 89-97 | 98-107 | 1-30 | 31-35 | 36-49 | 50-66 | 67-98 | 99-113 | 114-124 |
| 99 | 142 | 143 | 144 | 145 | 1-22 | 23-33 | 34-48 | 49-55 | 56-87 | 88-97 | 98-107 | 1-30 | 31-35 | 36-49 | 50-66 | 67-98 | 99-106 | 107-117 |
| 100 | 146 | 147 | 148 | 149 | 1-23 | 24-34 | 35-49 | 50-56 | 57-88 | 89-97 | 98-107 | 1-30 | 31-35 | 36-49 | 50-66 | 67-98 | 99-111 | 112-122 |
| 191 | 150 | 151 | 152 | 153 | 1-23 | 24-34 | 35-49 | 50-56 | 57-88 | 89-97 | 98-107 | 1-30 | 31-35 | 36-49 | 50-66 | 67-98 | 99-112 | 113-123 |
| 192 | 154 | 155 | 156 | 157 | 1-22 | 23-33 | 34-48 | 49-55 | 56-87 | 88-97 | 98-107 | 1-30 | 31-35 | 36-49 | 50-66 | 67-98 | 99-113 | 114-124 |
| 193 | 158 | 159 | 160 | 161 | 1-22 | 23-33 | 34-48 | 49-55 | 56-87 | 88-97 | 98-107 | 1-30 | 31-35 | 36-49 | 50-66 | 67-98 | 99-111 | 112-122 |
| 195 | 162 | 163 | 164 | 165 | 1-23 | 24-34 | 35-49 | 50-56 | 57-88 | 89-97 | 98-107 | 1-30 | 31-35 | 36-49 | 50-66 | 67-98 | 99-111 | 112-122 |
| 196 | 166 | 167 | 168 | 169 | 1-23 | 24-34 | 35-49 | 50-56 | 57-88 | 89-97 | 98-107 | 1-30 | 31-35 | 36-49 | 50-66 | 67-98 | 99-111 | 112-122 |
| 199 | 170 | 171 | 172 | 173 | 1-23 | 24-34 | 34-48 | 49-55 | 56-87 | 88-97 | 98-107 | 1-30 | 31-35 | 36-49 | 50-66 | 67-98 | 99-106 | 107-117 |
| 200 | 174 | 175 | 176 | 177 | 1-22 | 23-33 | 34-48 | 49-55 | 56-87 | 88-97 | 98-107 | 1-30 | 31-35 | 36-49 | 50-66 | 67-98 | 99-108 | 109-119 |
| 202 | 178 | 179 | 180 | 181 | 1-23 | 24-34 | 35-49 | 50-56 | 57-88 | 89-97 | 98-107 | 1-30 | 31-35 | 36-49 | 50-66 | 67-98 | 99-113 | 114-124 |
| 203 | 182 | 183 | 184 | 185 | 1-23 | 24-34 | 35-49 | 49-55 | 56-87 | 88-97 | 98-107 | 1-30 | 31-35 | 36-49 | 50-66 | 67-98 | 99-111 | 112-122 |
| 204 | 186 | 187 | 188 | 189 | 1-23 | 24-34 | 35-49 | 50-56 | 57-88 | 89-97 | 98-107 | 1-30 | 31-35 | 36-49 | 50-66 | 67-98 | 99-108 | 109-119 |
| 207 | 190 | 191 | 192 | 193 | 1-23 | 24-34 | 35-49 | 50-56 | 57-88 | 89-97 | 98-107 | 1-30 | 31-35 | 36-49 | 50-66 | 67-98 | 99-113 | 114-124 |
| 209 | 194 | 195 | 196 | 197 | 1-23 | 24-34 | 35-49 | 50-56 | 57-88 | 89-97 | 98-107 | 1-30 | 31-35 | 36-49 | 50-66 | 67-98 | 99-108 | 109-119 |
| 210 | 198 | 199 | 200 | 201 | 1-23 | 24-34 | 35-49 | 50-56 | 57-88 | 89-97 | 98-107 | 1-30 | 31-35 | 36-49 | 50-66 | 67-98 | 99-111 | 112-122 |
| 212 | 202 | 203 | 204 | 205 | 1-23 | 24-34 | 35-49 | 50-56 | 57-88 | 89-97 | 98-107 | 1-30 | 31-35 | 36-49 | 50-66 | 67-98 | 99-111 | 112-122 |
| 213 | 206 | 207 | 208 | 209 | 1-23 | 24-34 | 35-49 | 50-56 | 57-88 | 89-97 | 98-107 | 1-30 | 31-35 | 36-49 | 50-66 | 67-98 | 99-112 | 113-123 |
| 214 | 210 | 211 | 212 | 213 | 1-23 | 24-34 | 35-49 | 50-56 | 57-88 | 89-97 | 98-107 | 1-30 | 31-35 | 36-49 | 50-66 | 67-98 | 99-113 | 114-124 |
| 218 | 214 | 215 | 216 | 217 | 1-23 | 24-34 | 35-49 | 50-56 | 57-88 | 89-97 | 98-107 | 1-30 | 31-35 | 36-49 | 50-66 | 67-98 | 99-111 | 112-122 |
| 219 | 218 | 219 | 220 | 221 | 1-23 | 24-34 | 35-49 | 50-56 | 57-88 | 89-97 | 98-107 | 1-30 | 31-35 | 36-49 | 50-66 | 67-98 | 99-112 | 113-123 |
| 220 | 222 | 223 | 224 | 225 | 1-22 | 23-33 | 34-48 | 49-55 | 56-87 | 88-97 | 98-107 | 1-30 | 31-35 | 36-49 | 50-66 | 67-98 | 99-111 | 112-122 |
| 221 | 226 | 227 | 228 | 229 | 1-22 | 23-33 | 34-48 | 49-55 | 56-87 | 88-97 | 98-107 | 1-30 | 31-35 | 36-49 | 50-66 | 67-98 | 99-106 | 107-117 |
| 222 | 230 | 231 | 232 | 233 | 1-22 | 23-33 | 34-48 | 49-55 | 56-87 | 88-97 | 98-107 | 1-30 | 31-35 | 36-49 | 50-66 | 67-98 | 99-106 | 107-117 |
| 223 | 234 | 235 | 236 | 237 | 1-23 | 24-34 | 35-49 | 50-56 | 57-88 | 89-97 | 98-107 | 1-30 | 31-35 | 36-49 | 50-66 | 67-98 | 99-108 | 109-119 |
| 224 | 238 | 239 | 240 | 241 | 1-23 | 24-34 | 35-49 | 50-56 | 57-88 | 89-97 | 98-107 | 1-30 | 31-35 | 36-49 | 50-66 | 67-98 | 99-112 | 113-123 |
| 225 | 242 | 243 | 244 | 245 | 1-23 | 24-34 | 35-49 | 50-56 | 57-88 | 89-97 | 98-107 | 1-30 | 31-35 | 36-49 | 50-66 | 67-98 | 99-113 | 114-124 |
| 226 | 246 | 247 | 248 | 249 | 1-23 | 24-34 | 35-49 | 50-56 | 57-88 | 89-97 | 98-107 | 1-30 | 31-35 | 36-49 | 50-66 | 67-98 | 99-111 | 112-122 |
| 227 | 250 | 251 | 252 | 253 | 1-22 | 23-33 | 34-48 | 49-55 | 56-87 | 88-97 | 98-107 | 1-30 | 31-35 | 36-49 | 50-66 | 67-98 | 99-106 | 107-117 |
| 229 | 254 | 255 | 256 | 257 | 1-22 | 23-33 | 34-48 | 49-55 | 56-87 | 88-97 | 98-107 | 1-30 | 31-35 | 36-49 | 50-66 | 67-98 | 99-108 | 109-119 |
| 230 | 258 | 259 | 260 | 261 | 1-23 | 24-34 | 35-49 | 50-56 | 57-88 | 89-97 | 98-107 | 1-30 | 31-35 | 36-49 | 50-66 | 67-98 | 99-114 | 115-125 |
| 231 | 262 | 263 | 264 | 265 | 1-22 | 23-33 | 34-48 | 49-55 | 56-87 | 88-97 | 98-107 | 1-27 | 28-32 | 33-46 | 47-63 | 64-95 | 96-103 | 104-114 |

TABLE 1-continued

| Cluster # | VL nucleotide SEQ ID NO: | VH nucleotide SEQ ID NO: | VL polypeptide SEQ ID NO: | VH polypeptide SEQ ID NO: | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|---|---|---|---|
| 232 | 266 | 267 | 268 | 269 | 1-23 | 24-34 | 35-49 | 50-56 | 57-88 | 89-97 | 98-107 | 1-30 | 31-35 | 36-49 | 50-66 | 67-98 | 99-106 | 107-117 |
| 233 | 270 | 271 | 272 | 273 | 1-23 | 24-34 | 35-49 | 50-56 | 57-88 | 89-97 | 98-107 | 1-30 | 31-35 | 36-49 | 50-66 | 67-98 | 99-106 | 107-117 |
| 234 | 274 | 275 | 276 | 277 | 1-23 | 24-34 | 35-49 | 50-56 | 57-88 | 89-97 | 98-107 | 1-30 | 31-35 | 36-49 | 50-66 | 67-98 | 99-108 | 109-119 |
| 235 | 278 | 279 | 280 | 281 | 1-22 | 23-33 | 34-48 | 49-55 | 56-87 | 88-97 | 98-107 | 1-30 | 31-35 | 36-49 | 50-66 | 67-98 | 99-111 | 112-122 |
| 236 | 282 | 283 | 284 | 285 | 1-23 | 24-34 | 35-49 | 50-56 | 57-88 | 89-97 | 98-107 | 1-30 | 31-35 | 36-49 | 50-66 | 67-98 | 99-111 | 112-122 |
| 237 | 286 | 287 | 288 | 289 | 1-22 | 23-33 | 34-48 | 49-55 | 56-87 | 88-97 | 98-107 | 1-30 | 31-35 | 36-49 | 50-66 | 67-98 | 99-111 | 112-122 |
| 238 | 290 | 291 | 292 | 293 | 1-21 | 22-32 | 33-47 | 48-54 | 55-86 | 87-96 | 97-106 | 1-30 | 31-35 | 36-49 | 50-66 | 67-98 | 99-111 | 112-122 |
| 239 | 294 | 295 | 296 | 297 | 1-22 | 23-33 | 34-48 | 49-55 | 56-87 | 88-97 | 98-107 | 1-30 | 31-35 | 36-49 | 50-66 | 67-98 | 99-111 | 112-122 |
| 240 | 298 | 299 | 300 | 301 | 1-22 | 23-33 | 34-48 | 49-55 | 56-87 | 88-97 | 98-107 | 1-30 | 31-35 | 36-49 | 50-66 | 67-98 | 99-111 | 112-122 |
| 245 | 302 | 303 | 304 | 305 | 1-22 | 23-33 | 34-48 | 49-55 | 56-87 | 88-97 | 98-107 | 1-30 | 31-35 | 36-49 | 50-66 | 67-98 | 99-111 | 112-122 |
| 246 | 306 | 307 | 308 | 309 | 1-23 | 24-34 | 35-49 | 50-56 | 57-88 | 89-97 | 98-107 | 1-30 | 31-35 | 36-49 | 50-66 | 67-98 | 99-106 | 107-117 |
| 248 | 310 | 311 | 312 | 313 | 1-22 | 23-33 | 34-48 | 49-55 | 56-87 | 88-97 | 98-107 | 1-30 | 31-35 | 36-49 | 50-66 | 67-98 | 99-111 | 112-122 |
| 249 | 314 | 315 | 316 | 317 | 1-22 | 23-33 | 34-48 | 49-55 | 56-87 | 88-97 | 98-107 | 1-28 | 29-33 | 34-47 | 48-64 | 65-96 | 97-112 | 113-123 |
| 250 | 318 | 319 | 320 | 321 | 1-23 | 24-34 | 35-49 | 50-56 | 57-88 | 89-97 | 98-107 | 1-30 | 31-35 | 36-49 | 50-66 | 67-98 | 99-116 | 113-123 |
| 296 | None | 322 | None | 323 | — | — | — | — | — | — | — | 1-30 | 31-35 | 36-49 | 50-66 | 67-98 | 99-112 | 117-127 |
| 297 | 324 | None | 325 | None | 1-22 | 23-35 | 36-50 | 51-57 | 58-89 | 90-100 | 101-110 | — | — | — | — | — | — | — |

Table 2 below shows a list of the Fabs or scFvs that bind IL-23p19

TABLE 2

| Cluster # | VL nucleotide SEQ ID NO: | VH nucleotide SEQ ID NO: | VL polypeptide SEQ ID NO: | VH polypeptide SEQ ID NO: | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|---|---|---|---|
| 26 | 492 | 493 | 754 | 755 | 1-23 | 24-35 | 36-50 | 51-57 | 58-89 | 90-98 | 99-108 | 1-30 | 31-35 | 36-49 | 50-66 | 67-98 | 99-105 | 106-116 |
| 27 | 494 | 495 | 756 | 757 | 1-23 | 24-34 | 35-49 | 50-56 | 57-88 | 89-97 | 98-107 | 1-30 | 31-35 | 36-49 | 50-66 | 67-98 | 99-106 | 107-117 |
| 28 | 496 | 497 | 758 | 759 | 1-23 | 24-35 | 36-50 | 51-57 | 58-89 | 90-98 | 99-108 | 1-30 | 31-35 | 36-49 | 50-66 | 67-98 | 99-108 | 109-119 |
| 29 | 498 | 499 | 460 | 761 | 1-22 | 23-36 | 37-51 | 52-58 | 59-90 | 91-102 | 103-112 | 1-30 | 31-35 | 36-49 | 50-66 | 67-98 | 99-112 | 113-123 |
| 33 | 500 | 501 | 762 | 763 | 1-23 | 24-34 | 35-49 | 50-56 | 57-88 | 89-97 | 98-107 | 1-30 | 31-35 | 36-49 | 50-66 | 67-98 | 99-113 | 114-124 |
| 36 | 502 | 503 | 764 | 765 | 1-23 | 24-34 | 35-49 | 50-56 | 57-88 | 89-97 | 98-107 | 1-30 | 31-35 | 36-49 | 50-66 | 67-98 | 99-105 | 106-116 |
| 40 | 504 | 505 | 766 | 767 | 1-22 | 23-33 | 34-48 | 49-55 | 56-87 | 88-96 | 97-106 | 1-30 | 31-35 | 36-49 | 50-66 | 67-98 | 99-116 | 117-127 |
| 41 | 506 | 507 | 768 | 769 | 1-23 | 24-39 | 40-54 | 55-61 | 62-93 | 94-102 | 103-112 | 1-30 | 31-35 | 36-49 | 50-66 | 67-98 | 99-112 | 113-123 |
| 43 | 508 | 509 | 770 | 771 | 1-22 | 23-36 | 37-51 | 52-58 | 59-90 | 91-102 | 103-112 | 1-30 | 31-35 | 36-49 | 50-66 | 67-98 | 99-107 | 108-118 |
| 101 | 510 | 511 | 772 | 773 | 1-23 | 24-34 | 35-49 | 50-56 | 57-88 | 89-97 | 98-107 | 1-30 | 31-35 | 36-49 | 50-66 | 67-98 | 99-112 | 113-123 |
| 102 | 512 | 513 | 774 | 775 | 1-23 | 24-39 | 40-54 | 55-61 | 62-93 | 94-102 | 103-112 | 1-30 | 31-35 | 36-49 | 50-66 | 67-98 | 99-110 | 111-121 |
| 103 | 514 | 515 | 776 | 777 | 1-23 | 24-34 | 35-49 | 50-56 | 57-88 | 89-97 | 98-107 | 1-30 | 31-35 | 36-49 | 50-66 | 67-98 | 99-113 | 114-124 |
| 110 | 516 | 517 | 778 | 779 | 1-22 | 23-35 | 36-50 | 51-57 | 58-89 | 90-98 | 99-108 | 1-30 | 31-35 | 36-49 | 50-66 | 67-98 | 99-119 | 120-130 |
| 114 | 518 | 519 | 780 | 781 | 1-23 | 24-34 | 35-49 | 50-56 | 57-88 | 89-97 | 98-107 | 1-30 | 31-35 | 36-49 | 50-66 | 67-98 | 99-108 | 109-119 |
| 115 | 520 | 521 | 782 | 783 | 1-23 | 24-39 | 40-54 | 55-61 | 62-93 | 94-102 | 103-112 | 1-30 | 31-35 | 36-49 | 50-66 | 67-98 | 99-108 | 109-119 |
| 119 | 522 | 523 | 784 | 785 | 1-23 | 24-34 | 35-49 | 50-56 | 57-88 | 89-97 | 98-107 | 1-30 | 31-35 | 36-49 | 50-66 | 67-98 | 99-106 | 107-117 |
| 120 | 524 | 525 | 786 | 78 | 1-23 | 24-39 | 40-54 | 55-61 | 62-93 | 94-102 | 103-112 | 1-30 | 31-35 | 36-49 | 50-66 | 67-98 | 99-108 | 109-119 |
| 121 | 526 | 527 | 788 | 789 | 1-23 | 24-39 | 40-54 | 55-61 | 62-93 | 94-102 | 103-112 | 1-30 | 31-35 | 36-49 | 50-66 | 67-98 | 99-109 | 110-120 |
| 122 | 528 | 529 | 790 | 791 | 1-23 | 24-34 | 35-49 | 50-56 | 57-88 | 89-96 | 97-106 | 1-30 | 31-35 | 36-49 | 50-66 | 67-98 | 99-108 | 109-119 |
| 123 | 530 | 531 | 792 | 793 | 1-22 | 23-33 | 34-48 | 49-55 | 56-87 | 88-97 | 98-107 | 1-30 | 31-35 | 36-49 | 50-66 | 67-98 | 99-111 | 112-122 |
| 124 | 532 | 533 | 794 | 795 | 1-23 | 24-34 | 35-49 | 50-56 | 57-88 | 89-97 | 98-107 | 1-30 | 31-35 | 36-49 | 50-66 | 67-98 | 99-110 | 111-121 |
| 125 | 534 | 535 | 796 | 797 | 1-23 | 24-34 | 35-49 | 50-56 | 57-88 | 89-97 | 98-107 | 1-30 | 31-35 | 36-49 | 50-66 | 67-98 | 99-106 | 107-117 |
| 126 | 536 | 537 | 798 | 799 | 1-23 | 24-35 | 36-50 | 51-57 | 58-89 | 90-100 | 101-110 | 1-30 | 31-35 | 36-49 | 50-66 | 67-98 | 99-106 | 107-117 |
| 127 | 538 | 539 | 800 | 801 | 1-23 | 24-35 | 36-50 | 51-57 | 58-89 | 90-100 | 101-110 | 1-30 | 31-35 | 36-49 | 50-66 | 67-98 | 99-111 | 112-122 |
| 128 | 540 | 541 | 802 | 803 | 1-23 | 24-34 | 35-49 | 50-56 | 57-88 | 89-98 | 99-108 | 1-30 | 31-35 | 36-49 | 50-66 | 67-98 | 99-107 | 108-118 |
| 129 | 542 | 543 | 804 | 805 | 1-23 | 24-34 | 35-49 | 50-56 | 57-88 | 89-97 | 98-107 | 1-30 | 31-35 | 36-49 | 50-66 | 67-98 | 99-111 | 112-122 |
| 130 | 544 | 545 | 806 | 807 | 1-23 | 24-39 | 40-54 | 55-61 | 62-93 | 94-102 | 103-112 | 1-30 | 31-35 | 36-49 | 50-66 | 67-98 | 99-109 | 110-120 |
| 131 | 546 | 547 | 808 | 809 | 1-23 | 24-39 | 40-54 | 55-61 | 62-93 | 94-102 | 103-112 | 1-30 | 31-35 | 36-49 | 50-66 | 67-98 | 99-109 | 110-120 |
| 132 | 548 | 548 | 810 | 811 | 1-23 | 24-39 | 40-54 | 55-61 | 62-93 | 94-102 | 103-112 | 1-30 | 31-35 | 36-49 | 50-66 | 67-98 | 99-115 | 116-126 |
| 134 | 550 | 551 | 812 | 813 | 1-22 | 23-33 | 34-48 | 49-55 | 56-87 | 88-96 | 9 8-107 | 1-30 | 31-35 | 36-49 | 50-66 | 67-98 | 99-111 | 112-122 |
| 135 | 552 | 553 | 814 | 815 | 1-23 | 24-34 | 35-49 | 50-56 | 57-88 | 89-97 | 98-107 | 1-30 | 31-35 | 36-49 | 50-66 | 67-98 | 99-116 | 117-127 |
| 136 | 554 | 555 | 816 | 817 | 1-23 | 24-34 | 35-49 | 50-56 | 57-88 | 89-98 | 99-108 | 1-30 | 31-35 | 36-49 | 50-66 | 67-98 | 99-109 | 110-120 |
| 137 | 556 | 557 | 818 | 819 | 1-22 | 23-36 | 37-51 | 52-58 | 59-90 | 91-100 | 101-110 | 1-30 | 31-35 | 36-49 | 50-66 | 67-98 | 99-105 | 106-116 |
| 138 | 558 | 559 | 820 | 820 | 1-23 | 24-34 | 35-49 | 50-56 | 57-88 | 89-97 | 98-107 | 1-30 | 31-35 | 36-49 | 50-66 | 67-98 | 99-107 | 108-118 |
| 139 | 560 | 561 | 822 | 823 | 1-23 | 24-34 | 35-49 | 50-56 | 57-88 | 89-97 | 98-107 | 1-30 | 31-35 | 36-49 | 50-66 | 67-98 | 99-111 | 112-122 |
| 140 | 562 | 563 | 824 | 825 | 1-23 | 24-34 | 35-49 | 50-56 | 57-88 | 89-98 | 99-108 | 1-30 | 31-35 | 36-49 | 50-66 | 67-98 | 99-111 | 112-122 |
| 141 | 564 | 565 | 826 | 827 | 1-23 | 24-39 | 40-54 | 55-61 | 62-93 | 94-102 | 103-112 | 1-30 | 31-35 | 36-49 | 50-66 | 67-98 | 99-107 | 108-118 |
| 142 | 566 | 567 | 828 | 829 | 1-23 | 24-39 | 40-54 | 55-61 | 62-93 | 94-102 | 103-112 | 1-30 | 31-35 | 36-49 | 50-66 | 67-98 | 99-113 | 114-124 |
| 143 | 568 | 569 | 830 | 831 | 1-22 | 23-36 | 37-51 | 52-58 | 59-90 | 91-100 | 101-110 | 1-30 | 31-35 | 36-49 | 50-66 | 67-98 | 99-116 | 117-127 |
| 144 | 570 | 571 | 832 | 833 | 1-23 | 24-34 | 35-49 | 50-56 | 57-88 | 89-97 | 98-107 | 1-30 | 31-35 | 36-49 | 50-66 | 67-98 | 99-109 | 110-120 |
| 145 | 572 | 573 | 834 | 835 | 1-23 | 24-34 | 35-49 | 50-56 | 57-88 | 89-97 | 98-107 | 1-30 | 31-35 | 36-49 | 50-66 | 67-98 | 99-105 | 106-116 |
| 146 | 574 | 575 | 836 | 837 | 1-22 | 23-36 | 37-51 | 52-58 | 59-90 | 91-100 | 101-110 | 1-30 | 31-35 | 36-49 | 50-66 | 67-98 | 99-107 | 108-118 |
| 148 | 576 | 577 | 838 | 839 | 1-23 | 24-39 | 40-54 | 55-61 | 62-93 | 94-102 | 103-112 | 1-30 | 31-35 | 36-49 | 50-66 | 67-98 | 99-111 | 112-122 |
| 149 | 578 | 579 | 840 | 841 | 1-23 | 24-34 | 35-49 | 50-56 | 57-88 | 89-96 | 97-106 | 1-30 | 31-35 | 36-49 | 50-66 | 67-98 | 99-107 | 108-118 |
| 150 | 580 | 581 | 842 | 843 | 1-22 | 23-36 | 37-51 | 52-58 | 59-90 | 91-100 | 101-110 | 1-30 | 31-35 | 36-49 | 50-66 | 67-98 | 99-105 | 106-116 |
| 151 | 582 | 583 | 844 | 845 | 1-23 | 24-39 | 40-54 | 55-61 | 62-93 | 94-101 | 102-111 | 1-30 | 31-35 | 36-49 | 50-66 | 67-98 | 99-108 | 109-119 |
| 152 | 584 | 586 | 846 | 847 | 1-23 | 24-34 | 35-49 | 50-56 | 57-88 | 89-98 | 99-108 | 1-30 | 31-35 | 36-49 | 50-65 | 66-97 | 98-110 | 111-121 |

TABLE 2-continued

| Cluster # | VL nucleotide SEQ ID NO: | VH nucleotide SEQ ID NO: | VL polypeptide SEQ ID NO: | VH polypeptide SEQ ID NO: | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|---|---|---|---|
| 153 | 586 | 587 | 848 | 849 | 1-23 | 24-34 | 35-49 | 50-56 | 57-88 | 89-97 | 98-107 | 1-30 | 31-35 | 36-49 | 50-66 | 67-98 | 99-110 | 111-121 |
| 154 | 588 | 589 | 850 | 851 | 1-23 | 24-39 | 40-54 | 55-61 | 62-93 | 94-102 | 103-112 | 1-30 | 31-35 | 36-49 | 50-66 | 67-98 | 99-107 | 108-118 |
| 155 | 590 | 591 | 825 | 853 | 1-23 | 24-35 | 36-50 | 51-57 | 58-89 | 90-100 | 101-110 | 1-30 | 31-35 | 36-49 | 50-66 | 67-98 | 99-109 | 110-120 |
| 156 | 592 | 593 | 854 | 855 | 1-22 | 23-35 | 36-50 | 51-57 | 58-89 | 90-100 | 101-110 | 1-30 | 31-35 | 36-49 | 50-66 | 67-98 | 99-109 | 110-120 |
| 157 | 594 | 595 | 856 | 857 | 1-22 | 24-35 | 36-50 | 51-57 | 58-89 | 90-100 | 101-110 | 1-30 | 31-35 | 36-49 | 50-66 | 67-98 | 99-113 | 114-124 |
| 158 | 596 | 597 | 858 | 589 | 1-23 | 24-39 | 40-54 | 55-61 | 62-93 | 94-102 | 103-112 | 1-30 | 31-35 | 36-49 | 50-66 | 67-98 | 99-113 | 114-124 |
| 159 | 598 | 599 | 860 | 861 | 1-23 | 24-39 | 40-54 | 55-61 | 62-93 | 94-102 | 103-112 | 1-30 | 31-35 | 36-49 | 50-66 | 67-98 | 99-112 | 113-123 |
| 160 | 600 | 601 | 862 | 863 | 1-23 | 24-34 | 35-49 | 50-56 | 57-88 | 89-96 | 97-106 | 1-30 | 31-35 | 36-49 | 50-66 | 67-98 | 99-105 | 106-116 |
| 161 | 602 | 603 | 864 | 865 | 1-23 | 24-39 | 40-54 | 55-61 | 62-93 | 94-102 | 103-112 | 1-30 | 31-35 | 36-49 | 50-66 | 67-98 | 99-107 | 108-118 |
| 162 | 604 | 605 | 866 | 867 | 1-23 | 24-35 | 36-50 | 51-57 | 58-89 | 90-98 | 99-108 | 1-30 | 31-35 | 36-49 | 50-66 | 67-98 | 99-105 | 106-116 |
| 163 | 606 | 607 | 868 | 869 | 1-23 | 24-39 | 36-50 | 51-57 | 58-89 | 90-98 | 99-108 | 1-30 | 31-35 | 36-49 | 50-66 | 67-98 | 99-108 | 109-119 |
| 164 | 608 | 609 | 870 | 871 | 1-23 | 24-35 | 36-50 | 51-57 | 58-89 | 90-98 | 99-108 | 1-30 | 31-35 | 36-49 | 50-66 | 67-98 | 99-107 | 108-118 |
| 165 | 610 | 611 | 872 | 873 | 1-23 | 24-39 | 40-54 | 55-61 | 62-93 | 94-102 | 103-112 | 1-30 | 31-35 | 36-49 | 50-66 | 67-98 | 99-109 | 110-120 |
| 166 | 612 | 613 | 874 | 875 | 1-23 | 24-35 | 36-50 | 51-57 | 58-89 | 90-98 | 99-108 | 1-30 | 31-35 | 36-49 | 50-66 | 67-98 | 99-105 | 106-116 |
| 167 | 614 | 615 | 876 | 877 | 1-23 | 24-34 | 35-49 | 50-56 | 57-88 | 89-97 | 98-107 | 1-30 | 31-35 | 36-49 | 50-66 | 67-98 | 99-103 | 104-114 |
| 168 | 616 | 617 | 878 | 879 | 1-23 | 24-34 | 35-49 | 50-56 | 57-88 | 89-97 | 98-107 | 1-30 | 31-35 | 36-49 | 50-66 | 67-98 | 99-108 | 109-119 |
| 169 | 618 | 619 | 880 | 881 | 1-23 | 24-35 | 36-50 | 51-57 | 58-89 | 90-99 | 100-109 | 1-30 | 31-35 | 36-49 | 50-66 | 67-98 | 99-112 | 113-123 |
| 170 | 620 | 621 | 882 | 883 | 1-23 | 24-39 | 40-54 | 55-61 | 62-93 | 94-102 | 103-112 | 1-30 | 31-35 | 36-49 | 50-66 | 67-98 | 99-112 | 113-123 |
| 171 | 622 | 623 | 884 | 885 | 1-23 | 24-35 | 36-50 | 51-57 | 58-89 | 90-101 | 102-111 | 1-30 | 31-35 | 36-49 | 50-66 | 67-98 | 99-112 | 113-123 |
| 172 | 624 | 625 | 886 | 887 | 1-23 | 24-34 | 35-49 | 50-56 | 57-88 | 89-96 | 97-106 | 1-30 | 31-35 | 36-49 | 50-66 | 67-98 | 99-107 | 108-118 |
| 173 | 626 | 627 | 888 | 889 | 1-23 | 24-39 | 40-54 | 55-61 | 62-93 | 94-102 | 103-112 | 1-30 | 31-35 | 36-49 | 50-66 | 67-98 | 99-109 | 110-120 |
| 174 | 628 | 629 | 890 | 891 | 1-23 | 24-35 | 36-50 | 51-57 | 58-89 | 90-98 | 99-108 | 1-30 | 31-35 | 36-49 | 50-66 | 67-98 | 99-106 | 107-117 |
| 175 | 630 | 631 | 892 | 893 | 1-23 | 24-34 | 35-49 | 50-56 | 57-88 | 89-97 | 98-107 | 1-30 | 31-35 | 36-49 | 50-66 | 67-98 | 99-112 | 113-123 |
| 176 | 632 | 633 | 894 | 895 | 1-23 | 24-34 | 35-49 | 50-56 | 57-88 | 89-98 | 99-108 | 1-30 | 31-35 | 36-49 | 50-66 | 67-98 | 99-109 | 110-120 |
| 178 | 634 | 635 | 896 | 897 | 1-23 | 24-39 | 40-54 | 55-61 | 62-93 | 94-101 | 102-111 | 1-30 | 31-35 | 36-49 | 50-66 | 67-98 | 99-113 | 114-124 |
| 179 | 636 | 637 | 898 | 899 | 1-23 | 24-39 | 40-54 | 55-61 | 62-93 | 94-102 | 103-112 | 1-30 | 31-35 | 36-49 | 50-66 | 67-98 | 99-110 | 111-121 |
| 180 | 638 | 639 | 900 | 901 | 1-23 | 24-35 | 36-50 | 51-57 | 58-89 | 89-97 | 98-107 | 1-30 | 31-35 | 36-49 | 50-66 | 67-98 | 99-109 | 110-120 |
| 181 | 640 | 641 | 902 | 903 | 1-23 | 24-34 | 35-49 | 50-56 | 57-88 | 89-97 | 98-107 | 1-30 | 31-35 | 36-49 | 50-66 | 67-98 | 99-114 | 115-125 |
| 182 | 642 | 643 | 904 | 905 | 1-23 | 24-39 | 40-54 | 55-61 | 62-93 | 94-102 | 103-112 | 1-30 | 31-35 | 36-49 | 50-66 | 67-98 | 99-108 | 109-119 |
| 183 | 644 | 645 | 906 | 907 | 1-23 | 24-35 | 36-50 | 51-57 | 58-89 | 90-98 | 99-108 | 1-30 | 31-35 | 36-49 | 50-66 | 67-98 | 99-107 | 108-118 |
| 184 | 646 | 647 | 908 | 909 | 1-23 | 24-34 | 35-49 | 50-56 | 57-88 | 89-97 | 98-107 | 1-30 | 31-35 | 36-49 | 50-66 | 67-98 | 99-117 | 118-128 |
| 185 | 648 | 649 | 910 | 911 | 1-23 | 24-39 | 40-54 | 55-61 | 62-93 | 94-101 | 102-111 | 1-30 | 31-35 | 36-49 | 50-66 | 67-98 | 99-110 | 111-121 |
| 186 | 650 | 651 | 912 | 913 | 1-23 | 24-35 | 36-50 | 51-57 | 58-89 | 90-99 | 100-109 | 1-30 | 31-35 | 36-49 | 50-66 | 67-98 | 99-107 | 108-118 |
| 187 | 652 | 653 | 914 | 915 | 1-23 | 24-35 | 35-49 | 50-56 | 57-88 | 89-97 | 98-107 | 1-30 | 31-35 | 36-49 | 50-66 | 67-98 | 99-107 | 108-118 |
| 188 | 654 | 655 | 916 | 917 | 1-23 | 24-39 | 40-54 | 55-61 | 62-93 | 94-103 | 104-113 | 1-30 | 31-35 | 36-49 | 50-66 | 67-98 | 99-111 | 112-122 |
| 189 | 565 | 567 | 918 | 919 | 1-23 | 24-39 | 40-54 | 55-61 | 62-93 | 94-102 | 103-112 | 1-30 | 31-35 | 36-49 | 50-66 | 67-98 | 99-109 | 110-120 |
| 190 | 658 | 659 | 920 | 921 | 1-23 | 24-34 | 35-49 | 50-56 | 57-88 | 89-96 | 97-106 | 1-30 | 31-35 | 36-49 | 50-66 | 67-98 | 99-105 | 106-116 |
| 194 | 660 | 661 | 922 | 923 | 1-23 | 24-39 | 40-54 | 55-61 | 62-93 | 94-102 | 103-112 | 1-30 | 31-35 | 36-49 | 50-66 | 67-98 | 99-113 | 114-124 |
| 197 | 662 | 663 | 924 | 925 | 1-23 | 24-39 | 40-54 | 55-61 | 62-93 | 94-102 | 103-112 | 1-30 | 31-35 | 36-49 | 50-66 | 67-98 | 99-113 | 114-124 |
| 198 | 664 | 665 | 926 | 927 | 1-23 | 24-39 | 40-54 | 55-61 | 62-93 | 94-102 | 103-112 | 1-30 | 31-35 | 36-49 | 50-66 | 67-98 | 99-106 | 107-117 |
| 201 | 666 | 667 | 928 | 929 | 1-23 | 24-39 | 40-54 | 55-61 | 62-93 | 94-102 | 103-112 | 1-30 | 31-35 | 36-49 | 50-66 | 67-98 | 99-110 | 111-121 |
| 205 | 668 | 669 | 930 | 931 | 1-23 | 24-39 | 40-54 | 55-61 | 62-93 | 94-102 | 103-112 | 1-30 | 31-35 | 36-49 | 50-66 | 67-98 | 99-113 | 114-124 |
| 206 | 670 | 671 | 932 | 933 | 1-23 | 24-39 | 40-54 | 55-61 | 62-93 | 94-102 | 103-112 | 1-30 | 31-35 | 36-49 | 50-66 | 67-98 | 99-112 | 113-123 |
| 208 | None | 672 | None | 934 | — | — | — | — | — | — | — | 1-30 | 31-35 | 36-49 | 50-66 | 67-98 | 99-110 | 111-121 |
| 211 | 673 | 674 | 935 | 936 | 1-23 | 24-39 | 40-54 | 55-61 | 62-93 | 94-102 | 103-112 | 1-30 | 31-35 | 36-49 | 50-66 | 67-98 | 99-113 | 114-124 |
| 251 | 675 | 676 | 937 | 938 | 1-22 | 23-33 | 34-48 | 49-55 | 56-87 | 88-97 | 98-107 | 1-30 | 31-35 | 36-49 | 50-66 | 67-98 | 99-110 | 111-121 |
| 252 | 672 | 673 | 939 | 940 | 1-22 | 23-33 | 34-48 | 49-55 | 56-87 | 88-96 | 97-106 | 1-30 | 31-35 | 36-49 | 50-66 | 67-98 | 99-120 | 121-131 |
| 253 | 679 | 680 | 841 | 942 | 1-22 | 23-33 | 34-48 | 49-55 | 56-87 | 88-96 | 97-106 | 1-30 | 31-35 | 36-49 | 50-66 | 67-98 | 99-115 | 116-126 |

TABLE 2-continued

| Cluster # | VL nucleotide SEQ ID NO: | VH nucleotide SEQ ID NO: | VL polypeptide SEQ ID NO: | VH polypeptide SEQ ID NO: | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|---|---|---|---|
| 254 | 681 | 682 | 943 | 944 | 1-22 | 23-33 | 34-48 | 49-55 | 56-87 | 88-96 | 97-106 | 1-30 | 31-35 | 36-49 | 50-66 | 67-98 | 99-115 | 116-126 |
| 255 | 683 | 684 | 945 | 946 | 1-23 | 24-35 | 36-50 | 51-57 | 58-89 | 90-98 | 99-108 | 1-30 | 31-35 | 36-49 | 50-66 | 67-98 | 99-114 | 115-125 |
| 256 | 685 | 686 | 947 | 947 | 1-22 | 23-33 | 34-48 | 49-55 | 56-87 | 88-96 | 97-106 | 1-30 | 31-35 | 36-49 | 50-66 | 67-98 | 99-105 | 106-116 |
| 257 | 687 | 688 | 949 | 950 | 1-22 | 23-33 | 34-48 | 49-55 | 56-87 | 88-96 | 97-106 | 1-30 | 31-35 | 36-49 | 50-66 | 67-98 | 99-118 | 119-129 |
| 259 | 689 | 690 | 951 | 952 | 1-22 | 23-33 | 34-48 | 49-55 | 56-87 | 88-96 | 97-106 | 1-30 | 31-35 | 36-49 | 50-66 | 67-98 | 99-114 | 115-125 |
| 260 | 691 | 692 | 953 | 954 | 1-23 | 24-34 | 35-49 | 50-56 | 57-88 | 89-98 | 99-108 | 1-30 | 31-35 | 36-49 | 50-66 | 67-98 | 99-114 | 115-125 |
| 261 | 693 | 694 | 955 | 956 | 1-23 | 24-35 | 36-50 | 51-57 | 58-89 | 90-98 | 99-108 | 1-30 | 31-35 | 36-49 | 50-66 | 67-98 | 99-113 | 114-124 |
| 262 | 695 | 696 | 957 | 958 | 1-23 | 24-34 | 35-49 | 50-56 | 57-88 | 89-98 | 99-108 | 1-30 | 31-35 | 36-49 | 50-66 | 67-98 | 99-108 | 109-119 |
| 263 | 697 | 698 | 959 | 960 | 1-23 | 24-34 | 35-49 | 50-56 | 57-88 | 89-98 | 99-108 | 1-30 | 31-35 | 36-49 | 50-66 | 67-98 | 99-112 | 113-123 |
| 264 | 699 | 700 | 961 | 962 | 1-23 | 24-34 | 35-49 | 50-56 | 57-88 | 89-98 | 99-108 | 1-30 | 31-35 | 36-49 | 50-66 | 67-98 | 99-109 | 110-120 |
| 265 | 701 | 702 | 963 | 964 | 1-23 | 24-34 | 35-49 | 51-57 | 57-88 | 89-97 | 98-107 | 1-30 | 31-35 | 36-49 | 50-66 | 67-98 | 99-113 | 114-124 |
| 266 | 703 | 704 | 965 | 966 | 1-23 | 24-34 | 35-49 | 50-56 | 57-88 | 89-99 | 100-109 | 1-30 | 31-35 | 36-49 | 50-66 | 67-98 | 99-108 | 109-119 |
| 267 | 705 | 706 | 967 | 968 | 1-23 | 24-34 | 35-49 | 50-56 | 57-88 | 89-97 | 98-107 | 1-30 | 31-35 | 36-49 | 50-66 | 67-98 | 99-106 | 107-117 |
| 270 | 707 | 708 | 969 | 970 | 1-23 | 24-39 | 40-54 | 55-61 | 62-93 | 94-102 | 103-112 | 1-30 | 31-35 | 36-49 | 50-66 | 67-98 | 99-112 | 113-123 |
| 271 | 709 | 710 | 971 | 972 | 1-23 | 24-39 | 40-54 | 55-61 | 62-93 | 94-102 | 103-112 | 1-30 | 31-35 | 36-49 | 50-66 | 67-98 | 99-112 | 113-123 |
| 272 | 711 | 721 | 973 | 974 | 1-23 | 24-39 | 40-54 | 55-61 | 62-93 | 94-102 | 103-112 | 1-30 | 31-35 | 36-49 | 50-66 | 67-98 | 99-113 | 114-124 |
| 273 | 713 | 714 | 975 | 976 | 1-23 | 24-34 | 35-49 | 50-56 | 57-88 | 89-97 | 98-107 | 1-30 | 31-35 | 36-49 | 50-66 | 67-98 | 99-105 | 106-116 |
| 274 | 715 | 716 | 977 | 978 | 1-23 | 24-39 | 40-54 | 55-61 | 62-93 | 94-102 | 103-112 | 1-30 | 31-35 | 36-49 | 50-66 | 67-98 | 99-112 | 113-123 |
| 275 | 717 | 718 | 979 | 980 | 1-23 | 24-39 | 40-54 | 55-61 | 62-93 | 94-102 | 103-112 | 1-30 | 31-35 | 36-49 | 50-66 | 67-98 | 99-105 | 106-138 |
| 276 | 719 | 720 | 981 | 982 | 1-23 | 24-34 | 35-49 | 50-56 | 57-88 | 89-97 | 98-107 | 1-30 | 31-35 | 36-49 | 50-66 | 67-98 | 99-105 | 106-116 |
| 277 | 721 | 722 | 983 | 984 | 1-23 | 24-34 | 35-49 | 50-56 | 57-88 | 89-97 | 98-107 | 1-30 | 31-35 | 36-49 | 50-66 | 67-98 | 99-105 | 106-116 |
| 278 | 723 | 724 | 985 | 986 | 1-23 | 24-39 | 40-54 | 55-61 | 62-93 | 94-102 | 103-112 | 1-30 | 31-35 | 36-49 | 50-66 | 67-98 | 99-112 | 113-123 |
| 279 | 725 | 726 | 987 | 988 | 1-22 | 23-36 | 37-51 | 52-58 | 59-90 | 91-102 | 103-112 | 1-30 | 31-35 | 36-49 | 50-66 | 67-98 | 99-112 | 113-123 |
| 280 | 727 | 728 | 989 | 990 | 1-23 | 24-39 | 40-54 | 55-61 | 62-93 | 94-102 | 103-112 | 1-30 | 31-35 | 36-49 | 50-66 | 67-98 | 99-112 | 113-123 |
| 281 | 729 | 730 | 991 | 992 | 1-23 | 24-39 | 40-54 | 55-61 | 62-93 | 94-102 | 103-112 | 1-30 | 31-35 | 36-49 | 50-66 | 67-98 | 99-112 | 113-123 |
| 282 | 731 | 732 | 993 | 994 | 1-23 | 24-39 | 40-54 | 55-61 | 62-93 | 94-102 | 103-112 | 1-30 | 31-35 | 36-49 | 50-66 | 67-98 | 99-112 | 113-123 |
| 283 | 733 | 734 | 995 | 996 | 1-22 | 23-36 | 37-51 | 52-58 | 59-90 | 91-102 | 103-112 | 1-30 | 31-35 | 36-49 | 50-66 | 67-98 | 99-112 | 113-123 |
| 284 | 735 | 736 | 997 | 998 | 1-22 | 23-36 | 37-51 | 52-58 | 59-90 | 91-102 | 103-112 | 1-30 | 31-35 | 36-49 | 50-66 | 67-98 | 99-112 | 113-123 |
| 285 | 737 | 738 | 999 | 1000 | 1-23 | 24-39 | 40-54 | 55-61 | 62-93 | 94-102 | 103-112 | 1-30 | 31-35 | 36-49 | 50-66 | 67-98 | 99-112 | 113-123 |
| 287 | 739 | 740 | 1001 | 1002 | 1-22 | 23-36 | 37-51 | 52-58 | 59-90 | 91-102 | 103-112 | 1-30 | 31-35 | 36-49 | 50-66 | 67-98 | 99-113 | 114-124 |
| 288 | 741 | 742 | 1003 | 1004 | 1-22 | 23-36 | 37-51 | 52-58 | 59-90 | 91-102 | 103-112 | 1-30 | 31-35 | 36-49 | 50-66 | 67-98 | 99-112 | 113-123 |
| 289 | 743 | 744 | 1005 | 1006 | 1-23 | 24-39 | 40-54 | 55-61 | 62-93 | 94-102 | 103-112 | 1-30 | 31-35 | 36-49 | 50-66 | 67-98 | 99-112 | 113-123 |
| 290 | 745 | None | 1007 | None | 1-23 | 24-34 | 35-49 | 50-56 | 57-88 | 89-97 | 98-107 | — | — | — | — | — | — | — |
| 298 | None | 746 | None | 1008 | — | — | — | — | — | — | — | 1-30 | 31-35 | 36-49 | 50-66 | 67-98 | 99-115 | 116-126 |
| 299 | 747 | None | 1009 | None | 1-23 | 24-34 | 35-49 | 50-56 | 57-88 | 89-97 | 98-107 | — | — | — | — | — | — | — |
| 301 | 749 | None | 1011 | None | 1-23 | 24-34 | 35-49 | 50-56 | 57-88 | 89-97 | 98-107 | — | — | — | — | — | — | — |
| 304 | 750 | 751 | 1012 | 1013 | 1-22 | 23-36 | 37-51 | 52-58 | 59-90 | 91-102 | 103-112 | 1-30 | 31-35 | 36-49 | 50-66 | 67-98 | 99-112 | 113-123 |
| 305 | 752 | 753 | 1014 | 1015 | 1-22 | 23-36 | 37-51 | 52-58 | 59-90 | 91-102 | 103-112 | 1-30 | 31-35 | 36-49 | 50-66 | 67-98 | 99-112 | 113-123 |

TABLE 3

Correlation of cluster number with clones in cell-based assays:

| | Cluster number |
|---|---|
| IL-17A clones | |
| M7.19.D10 | 86 |
| M7.19.F4 | 83 |
| M7.20.E5 | 95 |
| M7.24.E8 | 99 |
| M7.20.G6 | 97 |
| M7.24.G6 | 100 |
| M7.24.E5 | 98 |
| [M7.19] E7 | 87 |
| M7.24.C2 | 87 |
| M7.20.F4 | 88 |
| M7.24.A5 | 88 |
| M7.24.A4 | 88 |
| M7.20.C10 | 94 |
| M7.20.F11 | 96 |
| M7.20.A9 | 90 |
| M7.24.D8 | 87 |
| [M7.19] E7 | 87 |
| IL-23p19 clones | |
| M7.12 B9 | 41 |
| M7.12 F9 | 29 |
| M7.9 G9 | 36 |
| M7.13 D7 | |
| M7.3 D4 | 101 |
| M7.9 A7 | 27 |
| M7.7 F5 | 102 |
| M7.12 A7 | 103 |
| M7.13 A6 | 103 |
| M7.36.B6 | 305 |
| M7.36.D3 | 304 |
| M7.35.E9 | 303 |
| M7.35.C9 | 302 |

The scFv entities that bind IL-17A or IL-23p19 can be oriented with the variable light region either amino terminal to the variable heavy region or carboxylterminal to it. Additionally, tandem scFvs can be prepared in a number of configurations, such that each target, i.e, IL-17A and IL-23p19 can be bound by its respective variable regions. Thus, the construct for a tandem scFV molecule can be prepared such that the variable light region and variable heavy region of one antibody can be interspersed with the variable light and variable heavy regions of the other antibody as long as the variable regions are able to bind the targets. Tandem scFv molecules that bind both targets can be prepared with a linker between the scFv entites, including a Gly-Ser linker comprising a series of glycine and serine residues and can also include additional amino acids. Tandem bispecific scFv molecules with the variable regions of cluster numbers c103 and c87 exhibited an IC50 (nM) of 4.3 in the assay described in Example 5 herein.

The antibodies and derivatives thereof of the invention have binding affinities that include a dissociation constant ($K_d$) of less than $1\times10^{-2}$. In some embodiments, the $K_d$ is less than $1\times10^{-3}$. In other embodiments, the $K_d$ is less than $1\times10^{-4}$. In some embodiments, the $K_d$ is less than $1\times10^{-5}$. In still other embodiments, the $K_d$ is less than $1\times10^{-6}$. In other embodiments, the $K_d$ is less than $1\times10^{-7}$. In other embodiments, the $K_d$ is less than $1\times10^{-8}$. In other embodiments, the $K_d$ is less than $1\times10^{-9}$. In other embodiments, the $K_d$ is less than $1\times10^{-10}$. In still other embodiments, the $K_d$ is less than $1\times10^{-11}$. In some embodiments, the $K_d$ is less than $1\times10^{-12}$. In other embodiments, the $K_d$ is less than $1\times10^{-13}$. In other embodiments, the $K_d$ is less than $1\times10^{-14}$. In still other embodiments, the $K_d$ is less than $1\times10^{-15}$.

The anti-IL-17A and anti-IL23p19 antibodies isolated and described herein have been grouped into families of consensus CDRs, which are shown in SEQ ID NOs: 31 to 77 for anti-IL-17A and SEQ ID NOs: 326 to 491 for anti-IL-23p19. Table 4, below correlates the SEQ ID NOs: with the anti-IL-17A consensus CDRs.

TABLE 4

| CDR family | LCDR1 | LCDR2 | LCDR3 | HCDR1 | HCDR2 | HCDR3 |
|---|---|---|---|---|---|---|
| A | 31 | 32 | 33 | 34 | 35 | 36-37 |
| B | 38 | 39 | 40 | 41 | 42 | 43 |
| C | 44 | 45 | 46 | 47 | 48 | 49-50 |
| D | 51 | 52 | 53 | 54 | 55 | 56-61 |
| E | 62 | 63 | 64 | 65 | 66 | 67 |
| F | 68 | 69 | 70 | 71 | 72 | 37, 57, 73-77 |

TABLE 5

| CDR family | LCDR1 | LCDR2 | LCDR3 | HCDR1 | HCDR2 | HCDR3 |
|---|---|---|---|---|---|---|
| A | 326 | 327 | 328 | 329 | 330 | 331-340 |
| B | 341 | 342 | 343 | 344 | 345 | 331, 346-352 |
| C | 353 | 354 | 355 | 356 | 357 | 358-364 |
| D | 365 | 366 | 367 | 368 | 369 | 370-372 |
| E | 373 | 374 | 375 | 376 | 377 | 378-404 |
| F | 405 | 406 | 407 | 408 | 409 | 410-411 |
| G | 412 | 413 | 414 | 415 | 416 | 417-420 |
| H | 421 | 422 | 423 | 424 | 425 | 426-429 |
| I | 430 | 431 | 432 | 433 | 434 | 435-450 |
| J | 451 | 452 | 453 | 453 | 455 | 456-458 |
| K | 459 | 460 | 461 | 462 | 463 | 464-466 |
| L | 467 | 468 | 469 | 470 | 471 | 472-475 |
| M | 476 | 477 | 478 | 479 | 480 | 481-490 |

Thus, the invention provides an antibody that binds a polypeptide comprising IL-17A (SEQ ID NO:2), wherein the antibody comprises: a light chain variable region comprising: i) a light chain CDR1 selected from the group consisting of: 1) SEQ ID NO: 31; 2) SEQ ID NO: 38; 3) SEQ ID NO: 44; 4) SEQ ID NO: 51; 5) SEQ ID NO: 62; and 6) SEQ ID NO: 68; and ii) a light chain CDR2 selected from the group consisting of: 1) SEQ ID NO: 32; 2) SEQ ID NO: 39; 3) SEQ ID NO: 45; 4) SEQ ID NO:52; 5) SEQ ID NO: 63; and 6) SEQ ID NO: 69; and iii) a light chain CDR3 selected from the group consisting of: 1) SEQ ID NO: 33; 2) SEQ ID NO: 40; 3) SEQ ID NO: 46; 4) SEQ ID NO: 53; 5) SEQ ID NO: 64; and 6) SEQ ID NO: 70; and b) a heavy chain variable region comprising: i) a heavy chain CDR1 selected from the group consisting of: 1) SEQ ID NO: 34; 2) SEQ ID NO: 41; 3) SEQ ID NO: 47; 4) SEQ ID NO: 54; 5) SEQ ID NO: 65; and 6) SEQ ID NO: 71; and ii) a heavy chain CDR2 selected from the group consisting of: 1) SEQ ID NO: 35; 2) SEQ ID NO: 42; 3) SEQ ID NO: 48; 4) SEQ ID NO: 55; 5) SEQ ID NO: 66; and 6) SEQ ID NO: 72; and iii) a heavy chain CDR3 selected from the group consisting of: 1) SEQ ID NO: 36-37; 2) SEQ ID NO: 43; 3) SEQ ID NO: 49-50; 4) SEQ ID NO: 56-61; 5) SEQ ID NO: 67; and 6) SEQ ID NO: 37, 57, and 73-77. Within an embodiment, the antibody is an antibody fragment. Within another embodiment the antibody is selected from the groups consisting of: Fv, Fab, Fab', F(ab)$_2$, F(ab')$_2$, scFv, and diabody. Within another embodiment the antibody is a bispecific molecule. Within another embodiment the antibody also binds IL-23p19 (SEQ ID NO: 4).

The invention provides an antibody that binds a polypeptide comprising SEQ ID NO:2, wherein the antibody is selected from the group consisting of: a) the antibody comprising the light chain CDR1 of SEQ ID NO: 31, the light chain CDR2 of SEQ ID NO: 32, the light chain CDR3 of SEQ ID NO: 33, the heavy chain CDR1 of SEQ ID NO:34, the heavy chain CDR2 of SEQ ID NO: 35, and wherein the heavy chain CDR3 is selected from SEQ ID NOs: 36-37; b) the antibody comprising the light chain CDR1 of SEQ ID NO: 38, the light chain CDR2 of SEQ ID NO: 39, the light chain CDR3 of SEQ ID NO: 40, the heavy chain CDR1 of SEQ ID NO: 41, the heavy chain CDR2 of SEQ ID NO: 42, and wherein the heavy chain CDR3 is SEQ ID NOs: 43; c) the antibody comprising the light chain CDR1 of SEQ ID NO: 44, the light chain CDR2 of SEQ ID NO: 45, the light chain CDR3 of SEQ ID NO:46, the heavy chain CDR1 of SEQ ID NO: 47, the heavy chain CDR2 of SEQ ID NO: 48, and wherein the heavy chain CDR3 is selected from SEQ ID NOs: 49-50; d) the antibody comprising the light chain CDR1 of SEQ ID NO: 51, the light chain CDR2 of SEQ ID NO: 52, the light chain CDR3 of SEQ ID NO: 53, the heavy chain CDR1 of SEQ ID NO: 54, the heavy chain CDR2 of SEQ ID NO: 55, and wherein the heavy chain CDR3 is selected from SEQ ID NOs: 56-61; e) the antibody comprising the light chain CDR1 of SEQ ID NO: 62, the light chain CDR2 of SEQ ID NO: 63, the light chain CDR3 of SEQ ID NO: 64, the heavy chain CDR1 of SEQ ID NO: 65, the heavy chain CDR2 of SEQ ID NO: 66, and wherein the heavy chain CDR3 is SEQ ID NOs: 67; and f) the antibody comprising the light chain CDR1 of SEQ ID NO: 68, the light chain CDR2 of SEQ ID NO: 69, the light chain CDR3 of SEQ ID NO: 70, the heavy chain CDR1 of SEQ ID NO:71, the heavy chain CDR2 of SEQ ID NO: 72, and wherein the heavy chain CDR3 is selected from SEQ ID NOs: 37, 57, or 73-77.

The invention provides an antibody that binds a polypeptide comprising IL-23 (SEQ ID NO:4), wherein the antibody comprises: i) a light chain CDR1 selected from the group consisting of: 1) SEQ ID NO: 326; 2) SEQ ID NO: 341; 3) SEQ ID NO: 353; 4) SEQ ID NO: 365; 5) SEQ ID NO: 373: 6) SEQ ID NO: 405; 7) SEQ ID NO: 412; 8) SEQ ID NO: 421; 9) SEQ ID NO: 430; 10) SEQ ID NO: 451; 11) SEQ ID NO: 459; 12) SEQ ID NO: 467; and 13) SEQ ID NO: 476; and ii) a light chain CDR2 selected from the group consisting of: 1) SEQ ID NO: 327; 2) SEQ ID NO: 342; 3) SEQ ID NO: 354; 4) SEQ ID NO: 366; 5) SEQ ID NO: 374; 6) SEQ ID NO: 406; 7) SEQ ID NO: 413; 8) SEQ ID NO: 422; 9) SEQ ID NO: 431; 10) SEQ ID NO: 452; 11) SEQ ID NO: 460; 12) SEQ ID NO: 468; and 13) SEQ ID NO: 477; and iii) a light chain CDR3 selected from the group consisting of: 1) SEQ ID NO: 328; 2) SEQ ID NO: 343; 3) SEQ ID NO: 355; 4) SEQ ID NO: 367; 5) SEQ ID NO: 375; 6) SEQ ID NO: 407; 7) SEQ ID NO: 414; 8) SEQ ID NO: 423; 9) SEQ ID NO: 432; 10) SEQ ID NO: 453; 11) SEQ ID NO: 461; 12) SEQ ID NO: 469; 13) SEQ ID NO: 478; and b) a heavy chain variable region comprising: i) a heavy chain CDR1 selected from the group consisting of: 1) SEQ ID NO: 329; 2) SEQ ID NO: 344; 3) SEQ ID NO: 356; 5) SEQ ID NO: 368; 5) SEQ ID NO: 376; 6) SEQ ID NO: 408; 7) SEQ ID NO: 415; 8) SEQ ID NO: 424; 9) SEQ ID NO: 433; 10) SEQ ID NO: 453; 11) SEQ ID NO: 462; 12) SEQ ID NO: 470; and 13) SEQ ID NO: 479; and ii) a heavy chain CDR2 selected from the group consisting of: 1) SEQ ID NO: 330; 2) SEQ ID NO: 345; 3) SEQ ID NO: 357; 4) SEQ ID NO: 369; 5) SEQ ID NO: 377; 6) SEQ ID NO: 409; 7) SEQ ID NO: 416; 8) SEQ ID NO: 425; 9) SEQ ID NO: 434; 10) SEQ ID NO: 455; 11) SEQ ID NO: 463; 12) SEQ ID NO: 471; and 13) SEQ ID NO: 480; and iii) a heavy chain CDR3 selected from the group consisting of: 1) SEQ ID NOs: 331-340; 2) SEQ ID NOs: 331, 346-352; 3) SEQ ID NOs: 358-364; 4) SEQ ID NOs: 370-372; 5) SEQ ID NOs: 378-404; 6) SEQ ID NOs: 410-411; 7) SEQ ID NOs: 417-420; 8) SEQ ID NOs: 426-429; 9) SEQ ID NOs: 435-450; 10) SEQ ID NOs: 456-458; 11) SEQ ID NOs: 464-466; 12) SEQ ID NOs: 472-475; and 13) SEQ ID NOs: 481-490. Within embodiments, the antibody is an antibody fragment, Fv, Fab, Fab', F(ab)$_2$, F(ab')$_2$, scFv, and diabody, and as bispecific molecule that binds IL-17A (SEQ ID NO: 2).

The invention provides an antibody selected from the group consisting of: a) the antibody comprising the light chain CDR1 of SEQ ID NO: 326, the light chain CDR2 of SEQ ID NO: 327, the light chain CDR3 of SEQ ID NO: 328, the heavy chain CDR1 of SEQ ID NO:329, the heavy chain CDR2 of SEQ ID NO: 330, and wherein the heavy chain CDR3 is selected from SEQ ID NOs: 331-340; b) the antibody comprising the light chain CDR1 of SEQ ID NO: 341, the light chain CDR2 of SEQ ID NO: 342, the light chain CDR3 of SEQ ID NO: 343, the heavy chain CDR1 of SEQ ID NO: 344, the heavy chain CDR2 of SEQ ID NO: 345 and wherein the heavy chain CDR3 is SEQ ID NOs: 331, and 346-352; c) the antibody comprising the light chain CDR1 of SEQ ID NO: 353, the light chain CDR2 of SEQ ID NO: 354, the light chain CDR3 of SEQ ID NO:355, the heavy chain CDR1 of SEQ ID NO: 356, the heavy chain CDR2 of SEQ ID NO: 357, and wherein the heavy chain CDR3 is selected from SEQ ID NOs: 358-364; d) the antibody comprising the light chain CDR1 of SEQ ID NO: 365, the light chain CDR2 of SEQ ID NO: 366, the light chain CDR3 of SEQ ID NO: 367, the heavy chain CDR1 of SEQ ID NO: 368, the heavy chain CDR2 of SEQ ID NO: 369, and wherein the heavy chain CDR3 is selected from SEQ ID NOs: 370-372; e) the antibody comprising the light chain CDR1 of SEQ ID NO: 373, the light chain CDR2 of SEQ ID NO: 374, the light chain CDR3 of SEQ ID NO: 375, the heavy chain CDR1 of SEQ ID NO: 376, the heavy chain CDR2 of SEQ ID NO: 377, and wherein the heavy chain CDR3 is SEQ ID NOs: 378-04; f) the antibody comprising the light chain CDR1 of SEQ ID NO: 405, the light chain CDR2 of SEQ ID NO: 406, the light chain CDR3 of SEQ ID NO: 407, the heavy chain CDR1 of SEQ ID NO:408, the heavy chain CDR2 of SEQ ID NO: 409, and wherein the heavy chain CDR3 is selected from SEQ ID NOs: 37, 57, or 410-411; g) the antibody comprising the light chain CDR1 of SEQ ID NO: 412, the light chain CDR2 of SEQ ID NO: 413, the light chain CDR3 of SEQ ID NO: 414, the heavy chain CDR1 of SEQ ID NO: 415, the heavy chain CDR2 of SEQ ID NO: 416, and wherein the heavy chain CDR3 is selected from SEQ ID NOs: 417-420; h) the antibody comprising the light chain CDR1 of SEQ ID NO: 421, the light chain CDR2 of SEQ ID NO: 422, the light chain CDR3 of SEQ ID NO: 423, the heavy chain CDR1 of SEQ ID NO:424, the heavy chain CDR2 of SEQ ID NO: 425, and wherein the heavy chain CDR3 is selected from SEQ ID NOs: 426-429; i) the antibody comprising the light chain CDR1 of SEQ ID NO: 430, the light chain CDR2 of SEQ ID NO: 431, the light chain CDR3 of SEQ ID NO: 432, the heavy chain CDR1 of SEQ ID NO: 433, the heavy chain CDR2 of SEQ ID NO: 434, and wherein the heavy chain CDR3 is selected from SEQ ID NOs: 435-450; j) the antibody comprising the light chain CDR1 of SEQ ID NO: 451, the light chain CDR2 of SEQ ID NO: 452, the light chain CDR3 of SEQ ID NO: 453, the heavy chain CDR1 of SEQ ID NO:454, the heavy chain CDR2 of SEQ ID NO: 455, and wherein the heavy chain CDR3 is selected from SEQ ID NOs: 456-458; k) the antibody comprising the light chain CDR1 of SEQ ID NO: 459, the light chain CDR2 of SEQ ID NO: 460, the light chain CDR3 of SEQ ID NO: 461, the heavy chain CDR1 of SEQ ID NO:462, the heavy chain CDR2 of SEQ ID NO: 463, and wherein the heavy chain CDR3 is selected from SEQ ID NOs:464-466; 1) the antibody comprising the light chain CDR1 of SEQ ID NO: 467, the light chain CDR2 of SEQ ID NO: 468, the light chain CDR3 of SEQ ID NO: 469, the heavy chain CDR1 of SEQ ID NO:470, the heavy chain CDR2 of SEQ ID NO: 471, and wherein the heavy chain CDR3 is selected from SEQ ID NOs: 472-475; and m) the antibody comprising the light chain CDR1 of SEQ ID NO: 476, the light chain CDR2 of SEQ ID NO: 477, the light chain CDR3 of SEQ ID NO: 478, the heavy chain CDR1 of SEQ ID NO:479, the heavy chain CDR2 of SEQ ID NO: 480, and wherein the heavy chain CDR3 is selected from SEQ ID NOs: 481-490. Within embodiments, the antibody is an antibody fragment, Fv, Fab, Fab', F(ab)$_2$, F(ab')$_2$, scFv, and diabody, and as bispecific molecule that binds IL-17A (SEQ ID NO: 2).

The invention provides antibodies that binds polypeptide comprising SEQ ID NO:2, wherein the portion of SEQ ID NO: 2 where the antibody binds is amino acid residues 77 to 85 of SEQ ID NO: 2. Antibodies to epitopes from other mammalian species of IL-17 can also be useful. As such, the invention provides antibodies that bind to binds a polypeptide comprising 1) SEQ ID NO: 1022 (cynomolgus monkey), wherein the portion of SEQ ID NO: 1022 where the antibody binds is selected from the group consisting of: a) amino acid residues 77 to 85 of SEQ ID NO: 1022; and b) amino acid residues 123 to 128 of SEQ ID NO: 1022; 2) SEQ ID NO:1023 (murine), wherein the portion of SEQ ID NO: 1023 where the antibody binds is selected from the group consisting of: a) amino acid residues 80 to 88 of SEQ ID NO: 1023; and b) amino acid residues 125 to 131 of SEQ ID NO: 1023; and c) SEQ ID NO:1024 (rat), wherein the portion of SEQ ID NO: 1024 where the antibody binds is selected from the group consisting of: a) amino acid residues 72 to 80 of SEQ ID NO: 1024; and b) amino acid residues 117 to 123 of SEQ ID NO: 1024.

The invention provides antibodies that neutralize the polypeptide comprising SEQ ID NO:2, wherein the portion of SEQ ID NO: 2 where the antibody binds is selected from the group consisting of: a) amino acid residues 34 to 41 of SEQ ID NO: 2; and b) amino acid residues 52 to 64 of SEQ ID NO: 2. Antibodies to epitopes from other mammalian species of IL-17 can also be useful. As such, the invention provides antibodies that bind to binds a polypeptide comprising 1) SEQ ID NO: 1022 (cynomologus monkey) where the antibody binds is selected from the group consisting of: a) amino acid residues 34 to 41 of SEQ ID NO: 1022; and b) amino acid residues 52 to 64 of SEQ ID NO: 1022; 2) SEQ ID NO: 1023 (murine) where the antibody binds is selected from the group consisting of: a) amino acid residues 36 to 43 of SEQ ID NO: 1023; and b) amino acid residues 60 to 67 of SEQ ID NO: 1023; 3) SEQ ID NO: 1024 (rat) where the antibody binds is amino acid residues 49 to 59 of SEQ ID NO: 1024.

The invention provides antibodies that binds a polypeptide comprising SEQ ID NO:4, wherein the portion of SEQ ID NO: 4 where the antibody binds is selected from the group consisting of: a) amino acid residues 55 to 66 of SEQ ID NO: 4; and b) amino acid residues 74 to 85 of SEQ ID NO: 4. Antibodies to epitopes from other mammalian species of IL-17 can also be useful. As such, the invention provides antibodies that bind to binds a polypeptide comprising 1) SEQ ID NO: 1025 (cyno) where the antibody binds is selected from the group consisting of: a) amino acid residues 55 to 66 of SEQ ID NO: 1025; and b) amino acid residues 74 to 85 of SEQ ID NO: 1025; 2) SEQ ID NO: 1026 (murine) where the antibody binds is selected from the group consisting of: a) amino acid residues 56 to 67 of SEQ ID NO: 1026; and b) amino acid residues 73-86 of SEQ ID NO: 1026; and 3) SEQ ID NO: 1027 (rat) where the antibody binds is selected from the group consisting of: a) amino acid residues 55 to 68 of SEQ ID NO: 1027; and b) amino acid residues 73 to 86 of SEQ ID NO: 1027.

The invention provides antibodies that neutralize the polypeptide comprising SEQ ID NO:2, wherein the portion of SEQ ID NO: 4 where the antibody binds is selected from the group consisting of: a) amino acid residues 137 to 146 of SEQ ID NO: 4; and b) amino acid residues 155 to 164 of SEQ ID NO: 4. Antibodies to epitopes from other mammalian species of IL-17 can also be useful. As such, the invention provides antibodies that bind to binds a polypeptide comprising 1) SEQ ID NO: 1025 (cyno) where the antibody binds is selected from the group consisting of: a) amino acid residues 137 to 146 of SEQ ID NO: 1025; and b) amino acid residues 155 to 164 of SEQ ID NO: 1025; 2) SEQ ID NO: 1026 (murine) where the antibody binds is selected from the group consisting of: a) amino acid residues 137 to 146 of SEQ ID NO: 1026; and b) amino acid residues 155 to 165 of SEQ ID NO: 1026; and 3) where the antibody binds is selected from the group consisting of: a) amino acid residues 137 to 147 of SEQ ID NO: 1027; and b) amino acid residues 155 to 165 of SEQ ID NO: 1027.

The invention provides an antibody that binds a polypeptide comprising IL-17A (SEQ ID NO: 2) comprising a light chain variable region selected from the group consisting of: SEQ ID NO: 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 292, 296, 300, 304, 308, 312, 316, 320, and 325. Within an embodiment, the antibody further comprising a heavy chain variable region selected from the group consisting of: SEQ ID NO: 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, and 323. Within an embodiment, the light chain variable region is amino terminus to the heavy chain variable region or the heavy chain variable region is amino terminal to the light chain variable region. Within an embodiment, the antibody is an antibody fragment. Within an embodiment, the antibody is selected from the group consisting of: Fv, Fab, Fab', F(ab)$_2$, F(ab')$_2$, scFv, and diabody. Within an embodiment, the antibody is a bispecific molecule. Within an embodiment, the bispecific molecule also binds IL-23p19 (SEQ ID NO: 4).

The invention provides an antibody that binds a polypeptide comprising SEQ ID NO: 2 comprising a heavy chain variable region selected from the group consisting of: SEQ ID NO: 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, and 323. Within an embodiment, the antibody further comprising a light chain variable region selected from the group consisting of: SEQ ID NO: 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 292, 296, 300, 304, 308, 312, 316, 320, and 325. Within an embodiment, the light chain variable region is amino terminus to the heavy chain variable region or the heavy chain variable region is amino terminal to the light chain variable region. Within an embodiment, the antibody is an antibody fragment. Within an embodiment, the antibody is selected from the groups consisting of: Fv, Fab, Fab', F(ab)₂, F(ab')₂, scFv, and diabody. Within an embodiment, the antibody is a bispecific molecule. Within an embodiment, the bispecific molecule also binds IL-23p19 (SEQ ID NO: 4).

The invention provides an antibody that binds a polypeptide comprising SEQ ID NO: 2 comprising a light chain variable region selected from the group consisting of: SEQ ID NO: 92, 80, 128, 144, 136, 148, 140, 96, 100, 124, 132, and 108 and comprising a heavy chain variable region selected from the group consisting of: SEQ ID NO: 93, 81, 129, 145, 137, 149, 141, 97, 101, 125, 133, and 109. Within an embodiment, the antibody is an antibody fragment. Within an embodiment, antibody is selected from the groups consisting of: Fv, Fab, Fab', F(ab)₂, F(ab')₂, scFv, and diabody. Within an embodiment, is a bispecific molecule. Within an embodiment, bispecific molecule also binds IL-23p19 (SEQ ID NO: 4).

The invention provides an antibody that binds a polypeptide comprising SEQ ID NO: 2, wherein the antibody comprises a light chain and a heavy chain selected from the group consisting of: a) a light chain comprising SEQ ID NO: 92 and a heavy chain comprising SEQ ID NO: 93; b) a light chain comprising SEQ ID NO: 80 and a heavy chain comprising SEQ ID NO: 81; c) a light chain comprising SEQ ID NO: 128 and a heavy chain comprising SEQ ID NO: 129; d) a light chain comprising SEQ ID NO: 144 and a heavy chain comprising SEQ ID NO: 145; e) a light chain comprising SEQ ID NO: 136 and a heavy chain comprising SEQ ID NO: 137; f) a light chain comprising SEQ ID NO: 148 and a heavy chain comprising SEQ ID NO: 149; g) a light chain comprising SEQ ID NO: 140 and a heavy chain comprising SEQ ID NO: 141; h) a light chain comprising SEQ ID NO: 96 and a heavy chain comprising SEQ ID NO: 97; i) a light chain comprising SEQ ID NO: 100 and a heavy chain comprising SEQ ID NO: 101; j) a light chain comprising SEQ ID NO: 124 and a heavy chain comprising SEQ ID NO: 125; k) a light chain comprising SEQ ID NO: 132 and a heavy chain comprising SEQ ID NO: 133; and ) a light chain comprising SEQ ID NO: 108 and a heavy chain comprising SEQ ID NO: 109. Within an embodiment, the antibody is an antibody fragment. Within an embodiment, the antibody is selected from the groups consisting of: Fv, Fab, Fab', F(ab)₂, F(ab')₂, scFv, and diabody. Within an embodiment, the antibody is a bispecific molecule. that also binds IL-23p19 (SEQ ID NO: 4). Within an embodiment, the light chain variable region is amino terminal or carboxyl terminal to the heavy chain variable region.

The invention provides an antibody that binds a polypeptide comprising SEQ ID NO: 2, wherein the antibody competes for binding with an antibody comprising a light chain and a heavy chain selected from the group consisting of: a) a light chain comprising SEQ ID NO: 92 and a heavy chain comprising SEQ ID NO: 93; b) a light chain comprising SEQ ID NO: 80 and a heavy chain comprising SEQ ID NO: 81; c) a light chain comprising SEQ ID NO: 128 and a heavy chain comprising SEQ ID NO: 129;d) a light chain comprising SEQ ID NO: 144 and a heavy chain comprising SEQ ID NO: 145; e) a light chain comprising SEQ ID NO: 136 and a heavy chain comprising SEQ ID NO: 137; f) a light chain comprising SEQ ID NO: 96 and a heavy chain comprising SEQ ID NO: 97; g) a light chain comprising SEQ ID NO: 100 and a heavy chain comprising SEQ ID NO: 101; h) a light chain comprising SEQ ID NO: 124 and a heavy chain comprising SEQ ID NO: 125; i) a light chain comprising SEQ ID NO: 132 and a heavy chain comprising SEQ ID NO: 133; a j) a light chain comprising SEQ ID NO: 108 and a heavy chain comprising SEQ ID NO: 109. Within embodiments, the antibody is an antibody fragment, Fv, Fab, Fab', F(ab)₂, F(ab')₂, scFv, and diabody, a bispecific molecule that also binds IL-23p19 (SEQ ID NO: 4).

The invention provides an antibody that binds a polypeptide comprising SEQ ID NO: 2, wherein the antibody competes for binding with an antibody comprising a light chain comprising SEQ ID NO: 148 and a heavy chain comprising SEQ ID NO: 149. Within embodiments, the antibody is an antibody fragment, Fv, Fab, Fab', F(ab)₂, F(ab')₂, scFv, and diabody, a bispecific molecule that also binds IL-23p19 (SEQ ID NO: 4).

The invention provides an antibody that binds a polypeptide comprising SEQ ID NO: 4 comprising a light chain variable region selected from the group consisting of: SEQ ID NO: 754, 756, 758, 460, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 825, 854, 856, 858, 860, 862, 864, 866, 868, 870, 872, 874, 876, 878, 880, 882, 884, 886, 888, 890, 892, 894, 896, 898, 902, 904, 906, 908, 910, 912, 914, 916, 918, 920, 922, 924, 926, 928, 930, 932, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1010, 1011, 1012, and 1014. Within an embodiment, the antibody further comprising a heavy chain variable region selected form the group consisting of: 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 820, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 903, 905, 907, 909, 911, 913, 915, 917, 919, 921, 923, 925, 927, 929, 931, 933, 934, 936, 938, 940, 942, 944, 946, 947, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1013, and 1015. Within embodiments the antibody is an antibody fragment, is selected from the groups consisting of: Fv, Fab, Fab', F(ab)₂, F(ab')₂, scFv, and diabody, is a bispecific molecule that binds IL-17A (SEQ ID NO: 2).

The invention provides an antibody that binds a polypeptide comprising SEQ ID NO: 4 comprising a light chain variable region selected from the group consisting of: SEQ ID NO: 768 and 764 and comprising a heavy chain variable region selected from the group consisting of: SEQ ID NO: 769 and 765. Within embodiments the antibody is an antibody fragment, is selected from the groups consisting of: Fv, Fab, Fab', F(ab)₂, F(ab')₂, scFv, and diabody, is a bispecific molecule that binds IL-17A (SEQ ID NO: 2).

The invention provides an antibody that binds a polypeptide comprising SEQ ID NO: 4 comprising a light chain variable region selected from the group consisting of: SEQ ID NO: 774 and 776 and comprising a heavy chain variable region selected from the group consisting of: SEQ ID NO: 775 and 777. Within embodiments the antibody is an antibody fragment, is selected from the groups consisting of: Fv, Fab, Fab', F(ab)₂, F(ab')₂, scFv, and diabody, is a bispecific molecule that binds IL-17A (SEQ ID NO: 2).

The invention provides methods of treating autoimmune diseases including multiple sclerosis, IBD, and demyelinating diseases. The invention provides, a method for inhibiting interleukin-17 (IL-17) production by T cells comprising treating said T cells with an antagonist of IL-17 and IL-23, wherein said IL-23 antagonist binds the p19 subunit of IL-23. The T cells may be activated and may be memory cells.

The invention provides methods of treating diseases characterized by elevated expression of IL-17 or IL-23 in a mammalian subject, comprising administering to said subject an effective amount of an antagonist of IL-17 and IL-23, including diseases such as multiple sclerosis (MS), chronic inflammation, autoimmune diabetes, rheumatoid arthritis (RA) and other arthritic conditions, asthma, systhemic lupus erythrematosus, psoriasis, Crohn's Disease, ulcerative colitis, irritable bowel syndrome (IBS) and inflammatory bowel disease (IBD). Within embodiments the antibody is an antibody fragment, is selected from the groups consisting of: Fv, Fab, Fab', F(ab)₂, F(ab')₂, scFv, and diabody, is a bispecific molecule that binds IL-17A (SEQ ID NO: 2) and IL-23p19 (SEQ ID NO: 4).

The invention provides a method for preventing, inhibiting, or reducing relapse in multiple sclerosis comprising administering a combination of an antagonist to IL-17A and an antagonist to IL-23p19. In an embodiment, the antagonist to IL-17A and the antagonist to IL-23p19 are co-administered. In another embodiment, the antagonist to IL-17A is a scFv molecule and the antagonist to IL-23p19 is a scFv molecule. In another embodiment, the antagonist to IL-17A and an antagonist to IL-23p19 are administered in one entity. Within an embodiment, the entity is a bispecific molecule. Within an embodiment, the antagonist to IL-17A comprises a light chain selected from the group consisting of: SEQ ID NO: 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 292, 296, 300, 304, 308, 312, 316, 320, and 325, and/or comprises a heavy chain selected from the group consisting of: SEQ ID NO: 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, and 323. Within an embodiment, the antagonist to IL-23p19 comprises a light chain selected from the group consisting of: SEQ ID NO: SEQ ID NO: 754, 756, 758, 460, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 825, 854, 856, 858, 860, 862, 864, 866, 868, 870, 872, 874, 876, 878, 880, 882, 884, 886, 888, 890, 892, 894, 896, 898, 902, 904, 906, 908, 910, 912, 914, 916, 918, 920, 922, 924, 926, 928, 930, 932, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1010, 1011, 1012, and 1014, and/or comprising a heavy chain variable region selected form the group consisting of: SEQ ID NO: 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 820, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 903, 905, 907, 909, 911, 913, 915, 917, 919, 921, 923, 925, 927, 929, 931, 933, 934, 936, 938, 940, 942, 944, 946, 947, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1013, and 1015. Similarly, the invention provides, a method for preventing, inhibiting, or reducing IBD comprising administering a combination of an antagonist to IL-17A and an antagonist to IL-23p19.

The invention provides an isolated antibody that binds both IL-17A (SEQ ID NO: 2) and IL-23p19 (SEQ ID NO: 4) comprising at least one of the following: a) a light chain variable region selected from the group consisting of: SEQ ID NO: 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 292, 296, 300, 304, 308, 312, 316, 320, and 325; b) a heavy chain variable region selected from the group consisting of: SEQ ID NO: 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, and 323; c) a light chain variable region selected from the group consisting of: SEQ ID NO: 754, 756, 758, 460, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 825, 854, 856, 858, 860, 862, 864, 866, 868, 870, 872, 874, 876, 878, 880, 882, 884, 886, 888, 890, 892, 894, 896, 898, 902, 904, 906, 908, 910, 912, 914, 916, 918, 920, 922, 924, 926, 928, 930, 932, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1010, 1011, 1012, and 1014; and d) a heavy chain variable region selected from the group consisting of: SEQ ID NO: 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 820, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 903, 905, 907, 909, 911, 913, 915, 917, 919, 921, 923, 925, 927, 929, 931, 933, 934, 936, 938, 940, 942, 944, 946, 947, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1013, and 1015.

D) Nucleic Acids

The invention also includes nucleic acids encoding the heavy chain and/or light chain of the antibodies of the invention. Nucleic acids of the invention include nucleic acids having at least 80%, more preferably at least about 90%, more preferably at least about 95%, and most preferably at least about 98% homology to nucleic acids of the invention. The terms "percent similarity", "percent identity" and "percent homology" when referring to a particular sequence are used as set forth in the University of Wisconsin GCG software program. Nucleic acids of the invention also include complementary nucleic acids. In some instances, the sequences will be fully complementary (no mismatches) when aligned. In other instances, there may be up to about a 20% mismatch in the sequences. In some embodiments of the invention are provided nucleic acids encoding both a heavy chain and a light chain of an antibody of the invention. One skilled in the art will know that the nucleic acid sequences provided herein can be exploited using codon optimization, degereate sequence, silent mutations, and other DNA techniques to optimize expression in a particular hosts. The invention encompasses such sequence modifications. The present invention provides polynucleotide molecules, including DNA and RNA molecules, that encode the anti-IL-17A and anti-IL-23p19 antibodies disclosed herein. Those skilled in the art will readily recognize that, in view of the degeneracy of the genetic code, considerable sequence variation is possible among these polynucleotide molecules.

Nucleic acids of the invention can be cloned into a vector, such as a plasmid, cosmid, bacmid, phage, artificial chromosome (BAC, YAC) or virus, into which another genetic sequence or element (either DNA or RNA) may be inserted so as to bring about the replication of the attached sequence or element. In some embodiments, the expression vector contains a constitutively active promoter segment (such as but not limited to CMV, SV40, Elongation Factor or LTR sequences) or an inducible promoter sequence such as the steroid inducible pIND vector (Invitrogen), where the expression of the nucleic acid can be regulated. Expression vectors of the invention may further comprise regulatory sequences, for example, an internal ribosomal entry site. The expression vector can be introduced into a cell by transfection, for example.

E) Methods of Producing Antibodies to IL-17 and IL-23

The invention also provides methods of producing monoclonal antibodies that specifically bind to IL-17 and IL-23, either singly or together. Antibodies of the invention may be produced in vivo or in vitro. One strategy for generating antibodies against both IL-17 and IL-23 involves immunizing animals with both IL-17 and IL-23. In some embodiments, animals are immunized with the monomeric or multimeric form of oth IL-17 and IL-23. Animals so immunized will produce antibodies against both IL-17 and IL-23. Standard methods are known for creating monoclonal antibodies including, but are not limited to, the hybridoma technique (see Kohler & Milstein, (1975) *Nature* 256:495-497); the trioma technique; the human B-cell hybridoma technique (see Kozbor et al. (1983) *Immunol. Today* 4:72) and the EBV hybridoma technique to produce human monoclonal antibodies (see Cole, et al. in MONOCLONAL ANTIBODIES AND CANCER THERAPY, Alan R. Liss, Inc., 1985, pp. 77-96).

Both IL-17 and IL-23 may be purified from cells or from recombinant systems using a variety of well-known techniques for isolating and purifying proteins. For example, but not by way of limitation, both IL-17 and IL-23 may be isolated based on the apparent molecular weight of the protein by running the protein on an SDS-PAGE gel and blotting the proteins onto a membrane. Thereafter, the appropriate size band corresponding to either protein may be cut from the membrane and used as an immunogen in animals directly, or by first extracting or eluting the protein from the membrane. As an alternative example, the protein may be isolated by size-exclusion chromatography alone or in combination with other means of isolation and purification.

The invention also provides methods of producing monoclonal antibodies that specifically bind to homodimeric, heterodimeric, and/or multimeric forms of both IL-17 and IL-23/p19. These different forms may be purified from cells or from recombinant systems using a variety of well-known techniques for isolating and purifying proteins. For example, but not by way of limitation, both IL-17 and IL-23/p19 may be isolated based on the apparent molecular weight of the protein by running the protein on an SDS-PAGE gel and blotting the proteins onto a membrane. Thereafter, the appropriate size band corresponding to each may be cut from the membrane and used as an immunogen in animals directly, or by first extracting or eluting the protein from the membrane. As an alternative example, the protein may be isolated by size-exclusion chromatography alone or in combination with other means of isolation and purification.

Other means of purification are available in such standard reference texts as Zola, *Monoclonal Antibodies: Preparation And Use Of Monoclonal Antibodies And Engineered ntibody Derivatives (Basics: From Background To Bench)* Springer-Verlag Ltd., New York, 2000; *Basic Methods In Antibody Production And Characterization*, Chapter 11, "Antibody Purification Methods," Howard and Bethell, Eds., CRC Press, 2000; *Antibody Engineering* (Springer Lab Manual.), Kontermann and Dubel, Eds., Springer-Verlag, 2001.

For in vivo antibody production, animals are generally immunized with either IL-17 or IL-23 or an immunogenic portion of either. The antigen is generally combined with an adjuvant to promote immunogenicity. Adjuvants vary according to the species used for immunization. Examples of adjuvants include, but are not limited to: Complete Freund's Adjuvant ("CFA"), Incomplete Freund's Adjuvant ("IFA"), mineral gels (e.g., aluminum hydroxide), surface active substances (e.g., lysolecithin, pluronic polyols, polyanions), peptides, oil emulsions, keyhole limpet hemocyanin ("KLH"), dinitrophenol ("DNP"), and potentially useful human adjuvants such as Bacille Calmette-Guerin ("BCG") and *corynebacterium parvum*. Such adjuvants are also well known in the art. Immunization may be accomplished using well-known procedures. The dose and immunization regimen will depend on the species of mammal immunized, its immune status, body weight, and/or calculated surface area, etc. Typically, blood serum is sampled from the immunized mammals and assayed for anti-IL-17 and IL-23/p19 antibodies using appropriate screening assays as described below, for example.

A common method for producing humanized antibodies is to graft CDR sequences from a MAb (produced by immunizing a rodent host) onto a human Ig backbone, and transfection of the chimeric genes into Chinese Hamster Ovary (CHO) cells which in turn produce a functional Ab that is secreted by the CHO cells (Shields, R. L., et al. (1995) *Int Arch. Allergy Immunol.* 107:412-413). The methods described within this application are also useful for generating genetic alterations within Ig genes or chimeric Igs transfected within host cells such as rodent cell lines, plants, yeast and prokaryotes (Frigerio L, et al. (2000) *Plant Physiol.* 123:1483-1494).

Splenocytes from immunized animals may be immortalized by fusing the splenocytes (containing the antibody-producing B cells) with an immortal cell line such as a myeloma line. Typically, myeloma cell line is from the same species as the splenocyte donor. In one embodiment, the immortal cell line is sensitive to culture medium containing hypoxanthine, aminopterin and thymidine ("HAT medium"). In some embodiments, the myeloma cells are negative for Epstein-Barr virus (EBV) infection. In preferred embodiments, the myeloma cells are HAT-sensitive, EBV negative and Ig expression negative. Any suitable myeloma may be used. Murine hybridomas may be generated using mouse myeloma cell lines (e.g., the P3-NS1/1-Ag4-1, P3-x63-Ag8.653 or Sp2/O-Ag14 myeloma lines). These murine myeloma lines are available from the ATCC. These myeloma cells are fused to the donor splenocytes polyethylene glycol ("PEG"), preferably 1500 molecular weight polyethylene glycol ("PEG 1500"). Hybridoma cells resulting from the fusion are selected in HAT medium which kills unfused and unproductively fused myeloma cells. Unfused splenocytes die over a short period of time in culture. In some embodiments, the myeloma cells do not express immunoglobulin genes.

Hybridomas producing a desired antibody which are detected by screening assays such as those described below may be used to produce antibodies in culture or in animals. For example, the hybridoma cells may be cultured in a nutrient medium under conditions and for a time sufficient to allow the hybridoma cells to secrete the monoclonal antibodies into the culture medium. These techniques and culture media are well known by those skilled in the art. Alternatively, the hybridoma cells may be injected into the peritoneum of an unimmunized animal. The cells proliferate in the peritoneal cavity and secrete the antibody, which accumulates as ascites fluid. The ascites fluid may be withdrawn from the peritoneal cavity with a syringe as a rich source of the monoclonal antibody.

Another non-limiting method for producing human antibodies is described in U.S. Pat. No. 5,789,650 which describes transgenic mammals that produce antibodies of another species (e.g., humans) with their own endogenous immunoglobulin genes being inactivated. The genes for the heterologous antibodies are encoded by human immunoglobulin genes. The transgenes containing the unrearranged immunoglobulin encoding regions are introduced into a non-human animal. The resulting transgenic animals are capable of functionally rearranging the transgenic immunoglobulin sequences and producing a repertoire of antibodies of various isotypes encoded by human immunoglobulin genes. The B-cells from the transgenic animals are subsequently immortalized by any of a variety of methods, including fusion with an immortalizing cell line (e.g., a myeloma cell).

The antibodies of the present invention may also be prepared in vitro using a variety of techniques known in the art. For example, but not by way of limitation, fully human monoclonal antibodies against IL-17 and IL-23/p19 may be prepared by using in vitro-primed human splenocytes (Boerner et al. (1991) *J. Immunol.* 147:86-95).

Alternatively, for example, the antibodies of the invention may be prepared by "repertoire cloning" (Persson et al. (1991) *Proc. Nat. Acad. Sci. USA* 88:2432-2436; and Huang and Stollar (1991) *J. Immunol. Methods* 141:227-236). Further, U.S. Pat. No. 5,798,230 describes preparation of human monoclonal antibodies from human B antibody-producing B cells that are immortalized by infection with an Epstein-Barr virus that expresses Epstein-Barr virus nuclear antigen 2 (EBNA2). EBNA2, required for immortalization, is then inactivated resulting in increased antibody titers.

In another embodiment, antibodies of the invention are formed by in vitro immunization of peripheral blood mononuclear cells ("PBMCs"). This may be accomplished by any means known in the art, such as, for example, using methods described in the literature (Zafiropoulos et al. (1997) *J. Immunological Methods* 200:181-190).

In a specific embodiment, bispecific and single chain antibodies that bind both IL-17 and IL-23 are made. One method of the present invention is a method for producing a bispecific IL-17/IL-23 antibody. The method comprises fusing hybridoma cells that secrete a monoclonal antibody that binds IL-17, with hybridoma cells that secrete a monoclonal antibody that binds IL-23/p19, thereby preparing a hybrid hybridoma that secretes a bispecific IL-17/IL-23 monclonal antibody. In one embodiment, the method comprises fusing hybridoma cells that secrete an antagonistic (or agonistic) IL-17 MAb, with hybridoma cells that secrete an antagonistic (or agonistic) IL-23/p19 MAb. Conventional techniques for conducting such a fusion, and for isolating the desired hybrid hybridoma, include those described elsewhere herein, and those illustrated in the examples below.

U.S. Pat. No. 6,060,285 discloses a process for the production of bispecific antibodies, in which at least the genes for the light chain and the variable portion of the heavy chain of an antibody having a first specificity are transfected into a hybridoma cell secreting an antibody having a second specificity. When the transfected hybridoma cells are cultured, bispecific antibodies are produced, and may be isolated by various means known in the art.

Other investigators have used chemical coupling of antibody fragments to prepare antigen-binding molecules having specificity for two different antigens (Brennan et al., *Science* 229:81 1985; Glennie et al., *J. Immunol.* 139:2367, 1987). U.S. Pat. No. 6,010,902 also discusses techniques known in the art by which bispecific antibodies can be prepared, for example by the use of heterobifunctional cross-linking reagents such as GMBS (maleimidobutryloxy succinimide) or SPDP (N-succinimidyl 3-(2-pyridyldithio)propionate). (See, e.g., Hardy, "Purification And Coupling Of Fluorescent Proteins For Use In Flow Cytometry", Handbook Of Experimental Immunology, 4.sup.th Ed., Volume 1, Immunochemistry, Weir et al. (eds.), pp. 31.4-31.12, 1986).

The ability to produce antibodies via recombinant DNA technology has facilitated production of bispecific antibodies. Kostelny et al utilized the leucine zipper moieties from the fos and jun proteins (which preferentially form heterodimers) to produce bispecific antibodies able to bind both the cell surface molecule CD3 and the receptor for IL-2 (*J. Immunol.* 148:1547; 1992).

Single chain antibodies may be formed by linking heavy and light chain variable region (Fv region) fragments via an amino acid bridge (short peptide linker), resulting in a single polypeptide chain. Such single-chain Fvs (scFvs) have been prepared by fusing DNA encoding a peptide linker between DNAs encoding the two variable region polypeptides (V.sub.L and V.sub.H). The resulting antibody fragments can form dimers or higher oligomers, depending on such factors as the length of a flexible linker between the two variable domains (Kortt et al., *Protein Engineering* 10:423, 1997). In particular embodiments, two or more scFvs are joined by use of a chemical cross-linking agent.

Techniques developed for the production of single chain antibodies can be adapted to produce single chain antibodies of the present invention, that bind both IL-17 and IL-23. Such techniques include those described in U.S. Pat. No. 4,946,778; Bird (*Science* 242:423, 1988); Huston et al. (*Proc. Natl. Acad. Sci. USA* 85:5879, 1988); and Ward et al. (*Nature* 334:544, 1989). Once desired single chain antibodies are identified (for example, from a phage-display library), those of skill in the art can further manipulate the DNA encoding the single chain antibody(ies) to yield bispecific antibodies, including bispecific antibodies having Fc regions.

Single chain antibodies against IL-17 and IL-23 may be concatamerized in either order (i.e., anti-IL-17-anti-IL-23 or anti-IL-23-anti-IL-17). In particular embodiments, starting materials for preparing a bispecific IL-17/IL-23 antibody include an antagonistic (or agonistic) single chain antibody directed against IL-17 and an antagonistic (or agonistic) single chain antibody directed against IL-23/p19.

U.S. Pat. No. 5,582,996 discloses the use of complementary interactive domains (such as leucine zipper moieties or other lock and key interactive domain structures) to facilitate heterodimer formation in the production of bispecific antibodies. The complementary interactive domain(s) may be inserted between an Fab fragment and another portion of a heavy chain (i.e., C.sub.H1 or C.sub.H2 regions of the heavy chain). The use of two different Fab fragments and complementary interactive domains that preferentially heterodimerize will result in bispecific antibody molecules. Cysteine residues may be introduced into the complementary interactive domains to allow disulphide bonding between the complementary interactive domains and stabilize the resulting bispecific antibodies.

Tetravalent, bispecific molecules can be prepared by fusion of DNA encoding the heavy chain of an F(ab').sub.2 fragment of an antibody with either DNA encoding the heavy chain of a second F(ab').sub.2 molecule (in which the CH1 domain is replaced by a CH3 domain), or with DNA encoding a single chain Fv fragment of an antibody, as described in U.S. Pat. No. 5,959,083. Expression of the resultant fusion genes in mammalian cells, together with the genes for the corresponding light chains, yields tetravalent bispecific molecules having specificity for selected antigens.

Bispecific antibodies can also be produced as described in U.S. Pat. No. 5,807,706, which is incorporated by reference herein. Generally, the method involves introducing a protuberance in a first polypeptide and a corresponding cavity in a second polypeptide, polypeptides interface. The protuberance and cavity are positioned so as to promote heteromultimer formation and hinder homomultimer formation. The protuberance is created by replacing amino acids having small side chains with amino acids having larger side chains. The cavity is created by the opposite approach, i.e., replacing amino acids having relatively large side chains with amino acids having smaller side chains.

The protuberance and cavity can be generated by conventional methods for making amino acid substitutions in polypeptides. For example, a nucleic acid encoding a polypeptide may be altered by conventional in vitro mutagenesis techniques. Alternatively, a polypeptide incorporating a desired amino acid substitution may be prepared by peptide synthesis. Amino acids chosen for substitution are located at the interface between the first and second polypeptides.

F) Screening for Antibody Specificity

Screening for antibodies that specifically bind to IL-17 and/or IL-23/p19 may be accomplished using the procedures ans assays known in the art and those described herein. For example, an enzyme-linked immunosorbent assay (ELISA) can be used in which microtiter plates are coated with either or both IL-17 and IL-23 (or p19 alone). In some embodiments, antibodies that bind both IL-17 and IL-23/p19 from positively reacting clones can be further screened for reactivity in an ELISA-based assay using microtiter plates coated with the other forms IL-17 and IL-23/p19, or other IL-17 family members. Clones that produce antibodies that are reactive to another forms or family members are eliminated, and clones that produce antibodies that are reactive to both IL-17 and IL-23/p19 may be selected for further expansion and development. Confirmation of reactivity of the antibodies to both IL-17 and IL-23/p19 may be accomplished, for example, using a Western Blot assay in which protein from ovarian, breast, renal, colorectal, lung, endometrial, or brain cancer cells and purified FR-.alpha. and other folate receptor isoforms are run on an SDS-PAGE gel, and subsequently are blotted onto a membrane. The membrane may then be probed with the putative anti-FR-.alpha. antibodies. Reactivity with both IL-17 and IL-23/p19 and not another family member confirms specificity of reactivity for both IL-17 and IL-23/p19.

In some embodiments, the binding affinity of the antibodies of the present invention antibodies is determined. Antibodies of the invention preferably have a binding affinity to IL-17 and IL-23/p19 (either singly or together as with a bispecific antibody or scFV) of at least about 1.times.10.sup.-7 M, more preferably at least about 1.times.10.sup.-8 M, more preferably at least about 1.times.10.sup.-9 M, and most preferably at least about 1.times.10.sup.-10 M. Preferred antibody-producing cells of the invention produce substantially only antibodies having a binding affinity to IL-17 and IL-23/p19 (either singly or together as with a bispecific antibody or scFV) of at least about 1.times.10.sup.-7 M, more preferably at least about 1.times.10.sup.-8 M, more preferably at least about 1.times.10.sup.-9 M, and most preferably at least about 1.times.10.sup.-10 M. Preferred compositions of the invention comprise substantially only antibodies having a binding affinity to both IL-17 and IL-23/p19 (either singly or together as with a bispecific antibody or scFV) of at least about 1.times.10.sup.-7 M, more preferably at least about 1.times.10.sup.-8 M, more preferably at least about 1.times.10.sup.-9 M, and most preferably at least about 1.times.10.sup.-10 M.

G) Anti-IL-17 and IL-23/p19 Antibody-Producing Cells

Antibody-producing cells of the invention include any insect expression cell line known, such as for example, *Spodoptera frugiperda* cells. The expression cell lines may also be yeast cell lines, such as, for example, *Saccharomyces cerevisiae* and *Schizosaccharomyces pombe* cells. The expression cells may also be mammalian cells such as, for example, hybridoma cells (e.g., NS0 cells), Chinese hamster ovary cells, baby hamster kidney cells, human embryonic kidney line 293, normal dog kidney cell lines, normal cat kidney cell lines, monkey kidney cells, African green monkey kidney cells, COS cells, and non-tumorigenic mouse myoblast G8 cells, fibroblast cell lines, myeloma cell lines, mouse NIH/3T3 cells, LMTK31 cells, mouse sertoli cells, human cervical carcinoma cells, buffalo rat liver cells, human lung cells, human liver cells, mouse mammary tumor cells, TR1 cells, MRC 5 cells, and FS4 cells.

In some preferred embodiments, the antibody-producing cells of the invention produce antibodies that specifically bind to IL-17 and IL-23/p19 (either singly or together as with a bispecific antibody or scFV). The cells preferably are substantially free of both IL-17 and IL-23 binding competitors. In preferred embodiments, the antibody-producing cells comprise less than about 10%, preferably less than about 5%, more preferably less than about 1%, more preferably less than about 0.5%, more preferably less than about 0.1%, and most preferably 0% by weight both IL-17 and IL-23 binding competitors. In some preferred embodiments, the antibodies produced by the antibody-producing cells are substantially free of both IL-17 and IL-23 competitors. In preferred embodiments, antibodies produced by the antibody-producing cells comprise less than about 10%, preferably less than about 5%, more preferably less than about 1%, more preferably less than about 0.5%, more preferably less than about 0.1%, and most preferably 0% by weight both IL-17 and IL-23 binding competitors. Preferred antibody-producing cells of the invention produce substantially only antibodies having a binding affinity to IL-17 and IL-23/p19 (either singly or together as with a bispecific antibody or scFV) of at least about 1.times.10.sup.-7 M, more preferably at least about 1.times.10.sup.-8 M, more preferably at least about 1.times.10.sup.-9 M, and most preferably at least about 1.times.10.sup.-10 M.

H) Antibody Purification

Methods of antibody purification are known in the art. In some embodiments of the invention, methods for antibody purification include filtration, affinity column chromatography, cation exchange chromatography, anion exchange chromatography, and concentration. The filtration step preferably comprises ultrafiltration, and more preferably ultrafiltration and diafiltration. Filtration is preferably performed at least about 5-50 times, more preferably 10 to 30 times, and most preferably 14 to 27 times. Affinity column chromatography, may be performed using, for example, PROSEP Affinity Chromatography (Millipore, Billerica, Mass.). In a preferred embodiment, the affinity chromatography step comprises PROSEP-VA column chromatography. Eluate may be washed in a solvent detergent. Cation exchange chromatography may include, for example, SP-Sepharose Cation Exchange Chromatography. Anion exchange chromatography may include, for example but not limited to, Q-Sepharose Fast Flow Anion Exchange. The anion exchange step is preferably non-binding, thereby allowing removal of contaminants including DNA and BSA. The antibody product is preferably nanofiltered, for example, using a Pall DV 20 Nanofilter. The antibody product may be concentrated, for example, using ultrafiltration and diafiltration. The method may further comprise a step of size exclusion chromatography to remove aggregates.

I) Therapeutic Uses of the IL-17 and IL-23/p19 Antibodies

Antibodies that bind to both IL-17 and IL-23 can be used to modulate the immune system by binding IL-17 and IL-23/p19 (either singly or together as with a bispecific antibody or scFV), and thus, preventing the binding of IL-17 with either IL-17RA and/or IL-17RC and IL-23 with its receptor (IL-12RB1/IL-23R) or any other receptor that they may bind, especially an IL-17 receptor family member. The antibodies of the invention can also be used to modulate the immune system by inhibiting the binding of both IL-17 with the endogenous IL-17RA and/or IL-17RC receptor and IL -23 with its endogenous receptor (IL-12RB1/IL-23R). The antibodies of the invention can be also used to treat a subject which produces an excess of either IL-17 and/or IL-23. Suitable subjects include mammals, such as humans. For example, the antibodies of the invention are useful in binding, blocking, inhibiting, reducing, antagonizing or neutralizing of both IL-17 and IL-23 (either singly or together as with a bispecific antibody or scFV), in the treatment of inflammation and inflammatory diseases such as multiple sclerosis, demyelinating diseases, autoimmune ocular disease, uveitis, scleritis, cancer (characterized by IL-17 and IL-23 expression), psoriasis, IBS, inflammatory bowel disease (IBD), colitis, promotion of tumor growth, arthritis, or degenerative joint disease and other inflammatory conditions disclosed herein.

Within preferred embodiments, the antibodies of the invention bind to, blocks, inhibits, reduces, antagonizes or neutralizes IL-23 (via p19) and IL-17 either singly or together (as with a bispecific antibody or scFV), in vivo.

Moreover, the antibodies of the invention are useful to:

(1) Block, inhibit, reduce, antagonize or neutralize signaling via IL-17 and IL-23 in the treatment of cancer, acute inflammation, and chronic inflammatory diseases such as inflammatory bowel disease (IBD), IBS, chronic colitis, splenomegaly, rheumatoid arthritis, and other diseases associated with the induction of acute-phase response.

(2) Block, inhibit, reduce, antagonize or neutralize signaling via IL-17 or IL-23 in the treatment of autoimmune diseases such as insulin-dependent diabetes mellitus (IDDM), multiple sclerosis (MS), demyelinating diseases, autoimmune ocular disease, uveitis, scleritis, systemic Lupus erythematosus (SLE), myasthenia gravis, rheumatoid arthritis, IBS and IBD to prevent or inhibit signaling in immune cells (e.g. lymphocytes, monocytes, leukocytes) via their receptors (e.g. IL-17RA and IL-17RC). Blocking, inhibiting, reducing, or antagonizing signaling via IL-17RA and IL-17RC, using the antibodies of the present invention, may also benefit diseases of the pancreas, kidney, pituitary and neuronal cells. IDDM, non-insulin dependent diabetes mellitus (IDDM), pancreatitis, and pancreatic carcinoma may benefit.

The antibodies described herein can be used to bind, block, inhibit, reduce, antagonize or neutralize IL-23 and IL-17 activity, either singly or together as with a bispecific antibody or scFV, in the treatment of multiple sclerosis, cancer, autoimmune disease, atopic disease, NIDDM, pancreatitis and kidney dysfunction as described above. The antibodies of the present invention are useful as antagonists of IL-17 or IL-23. Such antagonistic effects can be achieved by direct neutralization or binding of IL-17 and IL-23 (via p19).

Antibodies herein can also be directly or indirectly conjugated to drugs, toxins, radionuclides and the like, and these conjugates used for in vivo diagnostic or therapeutic applications. For instance, antibodies or binding polypeptides which recognize IL-17 or IL-23 can be used to identify or treat tissues or organs that express a corresponding anti-complementary molecule. More specifically, antibodies to IL-17 or IL-23 or bioactive fragments or portions thereof, can be coupled to detectable or cytotoxic molecules and delivered to a mammal having cells, tissues or organs that express these cytokines IL-17 or IL-23-expressing cancers.

Suitable detectable molecules may be directly or indirectly attached to the antagonists of the present invention, such as "binding polypeptides," (including binding peptides disclosed above), antibodies, or bioactive fragments or portions thereof. Suitable detectable molecules include radionuclides, enzymes, substrates, cofactors, inhibitors, fluorescent markers, chemiluminescent markers, magnetic particles and the like. Suitable cytotoxic molecules may be directly or indirectly attached to the polypeptide or antibody, and include bacterial or plant toxins (for instance, diphtheria toxin, *Pseudomonas* exotoxin, ricin, abrin and the like), as well as therapeutic radionuclides, such as iodine-131, rhenium-188 or yttrium-90 (either directly attached to the polypeptide or antibody, or indirectly attached through means of a chelating moiety, for instance). Binding polypeptides or antibodies may also be conjugated to cytotoxic drugs, such as adriamycin. For indirect attachment of a detectable or cytotoxic molecule, the detectable or cytotoxic molecule can be conjugated with a member of a complementary/anticomplementary pair, where the other member is bound to the binding polypeptide or antibody portion. For these purposes, biotin/streptavidin is an exemplary complementary/anticomplementary pair.

In another embodiment, binding polypeptide-toxin fusion proteins or antibody-toxin fusion proteins can be used for targeted cell or tissue inhibition or ablation (for instance, to treat cancer cells or tissues). Alternatively, if the binding polypeptide has multiple functional domains (i.e., an activation domain or a ligand binding domain, plus a targeting domain), a fusion protein including only the targeting domain may be suitable for directing a detectable molecule, a cytotoxic molecule or a complementary molecule to a cell or tissue type of interest. In instances where the fusion protein including only a single domain includes a complementary molecule, the anti-complementary molecule can be conjugated to a detectable or cytotoxic molecule. Such domain-complementary molecule fusion proteins thus represent a generic targeting vehicle for cell/tissue-specific delivery of generic anti-complementary-detectable/cytotoxic molecule conjugates.

Inflammation is a protective response by an organism to fend off an invading agent. Inflammation is a cascading event that involves many cellular and humoral mediators. On one hand, suppression of inflammatory responses can leave a host immunocompromised; however, if left unchecked, inflammation can lead to serious complications including chronic inflammatory diseases (e.g., asthma, psoriasis, arthritis, rheumatoid arthritis, multiple sclerosis, inflammatory bowel disease and the like), septic shock and multiple organ failure. Importantly, these diverse disease states share common inflammatory mediators. The collective diseases that are characterized by inflammation have a large impact on human morbidity and mortality. Therefore it is clear that anti-inflammatory proteins, such as antagonists to IL-17 and IL-23/p19, such as IL-17 and IL-23/p19 antibodies, could have crucial therapeutic potential for a vast number of human and animal diseases, from asthma and allergy to autoimmunity, cancers, and septic shock.

1. Arthritis

Arthritis, including osteoarthritis, rheumatoid arthritis, arthritic joints as a result of injury, and the like, are common inflammatory conditions which would benefit from the therapeutic use of anti-inflammatory proteins, such as the antagonists of the present invention. For example, rheumatoid arthritis (RA) is a systemic disease that affects the entire body and is one of the most common forms of arthritis. It is characterized by the inflammation of the membrane lining the joint, which causes pain, stiffness, warmth, redness and swelling. Inflammatory cells release enzymes that may digest bone and cartilage. As a result of rheumatoid arthritis, the inflamed joint lining, the synovium, can invade and damage bone and cartilage leading to joint deterioration and severe pain amongst other physiologic effects. The involved joint can lose its shape and alignment, resulting in pain and loss of movement.

Rheumatoid arthritis (RA) is an immune-mediated disease particularly characterized by inflammation and subsequent tissue damage leading to severe disability and increased mortality. A variety of cytokines are produced locally in the rheumatoid joints. Numerous studies have demonstrated that IL-1 and TNF-alpha, two prototypic pro-inflammatory cytokines, play an important role in the mechanisms involved in synovial inflammation and in progressive joint destruction. Indeed, the administration of TNF-alpha and IL-1 inhibitors in patients with RA has led to a dramatic improvement of clinical and biological signs of inflammation and a reduction of radiological signs of bone erosion and cartilage destruction. However, despite these encouraging results, a significant percentage of patients do not respond to these agents, suggesting that other mediators are also involved in the pathophysiology of arthritis (Gabay, *Expert. Opin. Biol. Ther.* 2(2): 135-149 (2002). One of those mediators could be IL-17 or IL-23, as demonstrated in several reports to play a role in rheumatoid arthritis. For example, IL-17 and IL-23/p19 are overexpressed in the synovium and synovial fibroblasts of patients with rheumatoid arthritis compared to individuals without rheumatoid arthritis. Furthermore, IL-17 and IL-23/p19 have been demonstrated to promote matrix degradation and enhance the expression of inflammatory, matrix-destructive cytokines when added to synovium/synoviocyte cultures. (Murphy et al., J. Exp. Med. 198:1951 (2003); reviewed in Lubberts et al, *Arthritis Res Ther.* 7:29 (2005) and Kim et al, Rheumatology, 46:57 (2007)). Therefore, such a molecule that binds or inhibits IL-17 or IL-23 activity, such as the antagonists of the present invention, could serve as a valuable therapeutic to reduce inflammation in rheumatoid arthritis, and other arthritic diseases.

There are several animal models for rheumatoid arthritis known in the art. For example, in the collagen-induced arthritis (CIA) model, mice develop chronic inflammatory arthritis that closely resembles human rheumatoid arthritis. Since CIA shares similar immunological and pathological features with RA, this makes it an ideal model for screening potential human anti-inflammatory compounds. The CIA model is a well-known model in mice that depends on both an immune response, and an inflammatory response, in order to occur. The immune response comprises the interaction of B-cells and CD4+ T-cells in response to collagen, which is given as antigen, and leads to the production of anti-collagen antibodies. The inflammatory phase is the result of tissue responses from mediators of inflammation, as a consequence of some of these antibodies cross-reacting to the mouse's native collagen and activating the complement cascade. An advantage in using the CIA model is that the basic mechanisms of pathogenesis are known. The relevant T-cell and B-cell epitopes on type II collagen have been identified, and various immunological (e.g., delayed-type hypersensitivity and anti-collagen antibody) and inflammatory (e.g., cytokines, chemokines, and matrix-degrading enzymes) parameters relating to immune-mediated arthritis have been determined, and can thus be used to assess test compound efficacy in the CIA model (Wooley, *Curr. Opin. Rheum.* 3:407-20 (1999); Williams et al., *Immunol.* 89:9784-788 (1992); Myers et al., *Life Sci.* 61:1861-78 (1997); and Wang et al., *Immunol.* 92:8955-959 (1995)).

One group has shown that an anti-mouse IL-17 antibody reduces symptoms in a mouse CIA-model relative to control mice, and another group has shown that deficiency of IL-23/p19 is protective in CIA (Murphy et al, J. Exp. Med. 198:1951 (2003)), thus showing conceptually that antagonists of the present invention may be beneficial in treating human disease. The administration of a single mouse-IL-17-specific rat antisera reduced the symptoms of arthritis in the animals when introduced prophylactically or after symptoms of arthritis were already present in the model (Lubberts et al, *Arthritis Rheum.* 50:650-9 (2004)).

As described in the Examples below, both IL-17 and IL-23/p19 are overexpressed in CIA. Therefore, antagonists of the present invention can be used to neutralize IL-17 and/or IL-23 (via p19) in the treatment of specific human diseases such as arthritis, psoriasis, psoriatic arthritis, endotoxemia, inflammatory bowel disease (IBD), IBS, colitis, and other inflammatory conditions disclosed herein.

The administration of antagonists of the present invention to these CIA model mice is used to evaluate the use of these antagonists to ameliorate symptoms and alter the course of disease. Moreover, results showing inhibition of IL-17 and/or IL-23 signalling by these antagonists would provide proof of concept that IL-17 and IL-23/p19 antagonists, such as those disclosed herein, can also be used to ameliorate symptoms and alter the course of disease. By way of example and without limitation, the injection of 10-200 ug of an anti-IL-17 and anti-IL-23/p19 per mouse (one to seven times a week for up to but not limited to 4 weeks via s.c., i.p., or i.m route of administration) can significantly reduce the disease score (paw score, incident of inflammation, or disease). Depending on the initiation of administration (e.g. prior to or at the time of collagen immunization, or at any time point following the second collagen immunization, including those time points at which the disease has already progressed), antagonists of the present invention can be efficacious in preventing rheumatoid arthritis, as well as preventing its progression.

2. Inflammatory Bowel Disease IBD

In the United States approximately 1.35 million in the US (more than 1.9 million in the G7 nations) have Inflammatory Bowel Disease (IBD) which can affect either colon and rectum (Ulcerative colitis) or both, small and large intestine (Crohn's Disease). In both Crohn's disease and ulcerative colitis, the tissue damage results from an inappropriate or exaggerated immune response to antigens of the gut microflora. Despite having a common basis in overresponsiveness to luminal antigens, Crohn's disease and ulcerative colitis are immunologically distinct entities. Crohn's disease is more associated with a Th1 T cell-mediated response, characterized by enhanced production of interferon-[gamma] and tumor necrosis factor-[alpha]. Interleukin (IL)-12 and, possibly, IL-23 govern the Th1 cell differentiation, but optimal induction and stabilization of polarized Th1 cells would require additional cytokines, such as IL-15, IL-18 and IL-21. In ulcerative colitis, the local immune response is less polarized, but it is characterized by CD 1-reactive natural killer T cell production of IL-13. Beyond these differences, Crohn's disease and ulcerative colitis share important end-stage effector pathways of intestinal injury, which are mediated by an active cross-talk between immune and non-immune mucosal cells. As shown in the Examples and references below, IL-17 and IL-23 are both overexpressed in intestines and/or serum from humans with IBD and in mouse models of IBD. (Nielson et al, Scand J. Gastroenterol. 38:180 (2003); Schmidt et al, Inflamm. Bowel Dis. 11:16 (2005); Fuss et al, Inflamm Bowel Dis. 12:9 (2006)). Moreover, neutralization of IL-17 and/or IL -23/p19 reduces disease symptoms and pathology in animals models of IBD (Yen et al, J. Clin. Invest. 116:1310 (2006); Zhang et al, Inflamm Bowel Dis. 12:382 (2006)).

As shown in the Examples below, both IL-17 and IL-23/p19 expression are increased in the DSS colitis model and in the T cell transfer colitis model, and treatment with a combination of an anti-IL-17A antibody and an anti-IL23p19 antibody is more efficacious in the oxazalone IBD model than treatment with either antibody alone. Thus, antagonists of the present invention could serve as a valuable therapeutic to reduce inflammation and pathological effects in IBD and related diseases.

Crohn's disease is a chronic, relapsing-remitting inflammatory disease of the intestinal tract. It is a chronic disease that often occurs at an early age, thus requiring patients to be treated for decades. In contrast to the more limited tissue layer involvement of ulcerative colitis (i.e. mucosa and submucosa of the colon), Crohn's disease can extend through all layers of the intestinal wall of both the large and small intestine. Symptoms of Crohn's disease include diarrhea, weight loss, blood, and abdominal pain. Complications are very serious and include intestinal fistulas, abscesses, and obstructions.

In healthy people, there is continuous, clinically undetected immune response to these antigens. In Crohn's disease, the response is prolonged and amplified. The precise cause nor the specific antigenic trigger has been identified, though it has been hypothesized to be a combination of a genetic predisposition plus an environmental trigger, such as exposure to endogenous or exogenous intestinal antigens. Therefore, in an effort to inhibit this characteristic aberrant immune response, immunosuppressive agents are used to treat CD patients. However, it is clear from the side effects of these drugs and the response/failure rate, that more selective and efficacious therapies are needed.

Many immune cells, including neutrophils, macrophages, B and T lymphocytes, and mast cell, are present in the mucosal layer of healthy intestines. The intact epithelium lining the mucosa prevents these cells from being overstimulated by the large antigenic load to which the GI tract is exposed on a daily basis. It is thought that Crohn's disease patients have increased intestinal permeability (perhaps because of the above mentioned genetic predisposition) that exposes the immune cells to numerous antigens. IL-23 and IL-17 appear to play a role in the overactive response and ensuing disease progression.

Ulcerative colitis (UC) is an inflammatory disease of the large intestine, commonly called the colon, characterized by inflammation and ulceration of the mucosa or innermost lining of the colon. This inflammation causes the colon to empty frequently, resulting in diarrhea. Symptoms include loosening of the stool and associated abdominal cramping, fever and weight loss.

Although the exact cause of UC is unknown, recent research suggests that the body's natural defenses are operating against proteins in the body which the body thinks are foreign (an "autoimmune reaction"). Perhaps because they resemble bacterial proteins in the gut, these proteins may either instigate or stimulate the inflammatory process that begins to destroy the lining of the colon. As the lining of the colon is destroyed, ulcers form releasing mucus, pus and blood. The disease usually begins in the rectal area and may eventually extend through the entire large bowel. Repeated episodes of inflammation lead to thickening of the wall of the intestine and rectum with scar tissue. Death of colon tissue or sepsis may occur with severe disease. The symptoms of ulcerative colitis vary in severity and their onset may be gradual or sudden. Attacks may be provoked by many factors, including respiratory infections or stress.

Although there is currently no cure for UC available, treatments are focused on suppressing the abnormal inflammatory process in the colon lining. Treatments including corticosteroids, immunosuppressives (e.g. azathioprine, mercaptopurine, and methotrexate) and aminosalicytates are available to treat the disease. However, the long-term use of immunosuppressives such as corticosteroids and azathioprine can result in serious side effects including thinning of bones, cataracts, infection, and liver and bone marrow effects. In the patients in whom current therapies are not successful, surgery is an option. The surgery involves the removal of the entire colon and the rectum.

There are several animal models that can partially mimic chronic ulcerative colitis. Some of the most widely used models are the is the 2,4,6-trinitrobenesulfonic acid/ethanol (TNBS) induced colitis model or the oxazalone model, which induce chronic inflammation and ulceration in the colon. When TNBS or oxazalone is introduced into the colon of susceptible mice via intra-rectal instillation, it induces T-cell mediated immune response in the colonic mucosa, in this case leading to a massive mucosal inflammation characterized by the dense infiltration of T-cells and macrophages throughout the entire wall of the large bowel. Moreover, this histopathologic picture is accompanies by the clinical picture of progressive weight loss (wasting), bloody diarrhea, rectal prolapse, and large bowel wall thickening (Neurath et al. *Intern. Rev. Immunol* 19:51-62, 2000).

Another colitis model uses dextran sulfate sodium (DSS), which induces an acute colitis manifested by bloody diarrhea, weight loss, shortening of the colon and mucosal ulceration with neutrophil infiltration. DSS-induced colitis is characterized histologically by infiltration of inflammatory cells into the lamina propria, with lymphoid hyperplasia, focal crypt damage, and epithelial ulceration. These changes are thought to develop due to a toxic effect of DSS on the epithelium and by phagocytosis of lamina propria cells and production of TNF-alpha and IFN-gamma. Despite its common use, several issues regarding the mechanisms of DSS about the relevance to the human disease remain unresolved. DSS is regarded as a T cell-independent model because it is observed in T cell-deficient animals such as SCID mice.

The administration of antagonists of the present invention to these TNBS, DSS, oxazalone, or T cell transfer models can be used to evaluate the use of those antagonists to ameliorate symptoms and alter the course of gastrointestinal disease. Moreover, the results showing inhibition of IL-17 and IL-23 signalling provide proof of concept that other IL-17/IL-23 antagonists can also be used to ameliorate symptoms in the colitis/IBD models and alter the course of disease. See Example 28.

3. Psoriasis

Psoriasis is a chronic skin condition that affects more than seven million Americans. Psoriasis occurs when new skin cells grow abnormally, resulting in inflamed, swollen, and scaly patches of skin where the old skin has not shed quickly enough. Plaque psoriasis, the most common form, is characterized by inflamed patches of skin ("lesions") topped with silvery white scales. Psoriasis may be limited to a few plaques or involve moderate to extensive areas of skin, appearing most commonly on the scalp, knees, elbows and trunk. Although it is highly visible, psoriasis is not a contagious disease. The pathogenesis of the diseases involves chronic inflammation of the affected tissues. IL-17 and IL-23 are both overexpressed in psoriatic skin compared to non-psoriatic skin (Li et al, *J Huazhong Univ Sci Technolog Med. Sci.* 24:294 (2004); Piskin et al, *J Immunol.* 176:1908 (2006)). Therefore, antagonists of the present invention could serve as a valuable therapeutic to reduce inflammation and pathological effects in psoriasis, other inflammatory skin diseases, skin and mucosal allergies, and related diseases.

Psoriasis is a T-cell mediated inflammatory disorder of the skin that can cause considerable discomfort. It is a disease for which there is no cure and affects people of all ages. Psoriasis affects approximately two percent of the populations of European and North America. Although individuals with mild psoriasis can often control their disease with topical agents, more than one million patients worldwide require ultraviolet or systemic immunosuppressive therapy. Unfortunately, the inconvenience and risks of ultraviolet radiation and the toxicities of many therapies limit their long-term use. Moreover, patients usually have recurrence of psoriasis, and in some cases rebound, shortly after stopping immunosuppressive therapy.

In addition to other disease models described herein, the activity of antagonists of the present invention on inflammatory tissue derived from human psoriatic lesions can be measured in vivo using a severe combined immune deficient (SCID) mouse model. Several mouse models have been developed in which human cells are implanted into immunodeficient mice (collectively referred to as xenograft models); see, for example, Cattan A R, Douglas E, *Leuk. Res.* 18:513-22 (1994) and Flavell, D J, *Hematological Oncology* 14:67-82 (1996). As an in vivo xenograft model for psoriasis, human psoriatic skin tissue is implanted into the SCID mouse model, and challenged with an appropriate antagonist. Moreover, other psoriasis animal models in ther art may be used to evaluate the present antagonists, such as human psoriatic skin grafts implanted into AGR129 mouse model, and challenged with an appropriate antagonist (e.g., see, Boyman, O. et al, *J. Exp. Med.* 199:731 (2004), incorporated herein by reference). IL-17/IL-23 antibodies or binding peptides that bind, block, inhibit, reduce, antagonize or neutralize the activity of IL-17, IL-23 or both IL-17 and IL-23 are preferred antagonists. Similarly, tissues or cells derived from human colitis, IBD, arthritis, or other inflammatory lestions can be used in the SCID model to assess the anti-inflammatory properties of the IL-17 and IL-23 antagonists described herein.

Efficacy of treatment is measured and statistically evaluated as increased anti-inflammatory effect within the treated population over time using methods well known in the art. Some exemplary methods include, but are not limited to measuring for example, in a psoriasis model, epidermal thickness, the number of inflammatory cells in the upper dermis, and the grades of parakeratosis. Such methods are known in the art and described herein. For example, see Zeigler, M. et al. *Lab Invest* 81:1253 (2001); Zollner, T. M. et al. *J. Clin. Invest.* 109:671 (2002); Yamanaka, N. et al. *Microbio.l Immunol* 45:507 (2001); Raychaudhuri, S. P. et al. *Br. J. Dermatol* 144:931 (2001); Boehncke, W. H et al. *Arch. Dermatol Res.* 291:104, (1999); Boehncke, W. H et al. *J. Invest. Dermatol.* 116:596 (2001); Nickoloff, B. J. et al. *Am. J. Pathol* 146:580 (1995); Boehncke, W. H et al. *J. Cutan. Pathol.* 24:1, (1997); Sugai, J., M. et al. *J. Dermatol. Sci.* 17:85 (1998); and Villadsen L. S. et al. *J. Clin. Invest.* 112:1571 (2003). Inflammation may also be monitored over time using well-known methods such as flow cytometry (or PCR) to quantitate the number of inflammatory or lesional cells present in a sample, score (weight loss, diarrhea, rectal bleeding, colon length) for IBD. For example, therapeutic strategies appropriate for testing in such a model include direct treatment using IL-17 and IL-23 antagonists (singly or together), or related conjugates or antagonists based on the disrupting interaction of IL-17 and IL-23 with their receptors.

4. Atopic Dermatitis.

AD is a common chronic inflammatory disease that is characterized by hyperactivated cytokines of the helper T cell subset 2 (Th2). Although the exact etiology of AD is unknown, multiple factors have been implicated, including hyperactive Th2 immune responses, autoimmunity, infection, allergens, and genetic predisposition. Key features of the disease include xerosis (dryness of the skin), pruritus (itchiness of the skin), conjunctivitis, inflammatory skin lesions, *Staphylococcus aureus* infection, elevated blood eosinophilia, elevation of serum IgE and IgG1, and chronic dermatitis with T cell, mast cell, macrophage and eosinophil infiltration. Colonization or infection with *S. aureus* has been recognized to exacerbate AD and perpetuate chronicity of this skin disease.

AD is often found in patients with asthma and allergic rhinitis, and is frequently the initial manifestation of allergic disease. About 20% of the population in Western countries suffer from these allergic diseases, and the incidence of AD in developed countries is rising for unknown reasons. AD typically begins in childhood and can often persist through adolescence into adulthood. Current treatments for AD include topical corticosteroids, oral cyclosporin A, non-corticosteroid immunosuppressants such as tacrolimus (FK506 in ointment form), and interferon-gamma. Despite the variety of treatments for AD, many patients' symptoms do not improve, or they have adverse reactions to medications, requiring the search for other, more effective therapeutic agents. The antagonists of the present invention can be used to neutralize IL-17 and IL-23 (via p19) in the treatment of specific human diseases such as atoptic dermatitis, inflammatory skin conditions, and other inflammatory conditions disclosed herein.

5. Asthma

IL-17 plays an important role in allergen-induced T cell activation and neutrophilic influx in the airways. The receptor for IL-17 is expressed in the airways (Yao, et al. *Immunity* 3:811 (1995)) and IL-17 mediated neutrophil recruitment in allergic asthma is largely induced by the chemoattractant IL-8, GRO-alpha and macrophage inflammatory protein-2 (MIP-2) produced by IL-17 stimulated human bronchial epithelial cells (HBECs) and human bronichial fibroblasts (Yao, et al. *J Immunol* 155:5483 (1995)); Molet, et al. *J Allergy Clin Immunol* 108:430 (2001)). IL-17 also stimulates HBECs to release IL-6, a neutrophil-activating factor (Fossiez, et al, *J Exp Med* 183:2593 (1996), and Linden, et al. *Int Arch Allergy Immunol* 126: 179 (2001)) and has been shown to synergize with TNF-alpha to prolong the survival of human neutrophils in vitro (Laan, et al. *Eur Respir J* 21:387 (2003)). Moreover, IL-17 is capable of amplifying the inflammatory responses in asthma by its ability to enhance the secretion of cytokines implicated in airway remodeling such as the profibrotic cytokines, IL-6 and IL-11 and inflammatory mediators granulocyte colony-stimulating factor (G-CSF) and granulocyte macrophage colony-stimulating factor (GM-CSF) (Molet, et al. *J Allergy Clin Immunol* 108:430 (2001)).

Clinical evidence shows that acute, severe exacerbations of asthma are associated with recruitment and activation of neutrophils in the airways, thus IL-17 is likely to play a significant role in asthma. Furthermore, since IL-23 is important in the maintenance and differentiation of IL-17 producing cells (e.g. Th17 cells), IL-23 is also likely to play a role in asthma. Patients with mild asthma display a detectable increase in the local concentration of free, soluble IL-17 protein (Molet, et al. *J Allergy Clin Immunol* 108:430 (2001)) while healthy human volunteers with induced, severe airway inflammation due to the exposure to a swine confinement, display a pronounced increase in the concentration of free, soluble IL-17 protein in the bronchoalveolar space (Fossiez et al, *J Exp Med* 183:2593 (1996), and Linden, et al. *Int Arch Allergy Immunol* 126:179 (2001)). Furthermore, IL-17 levels in sputum have correlated with individuals who have increased airway hyper-reactivity Barczyk, et al. *Respir Med* 97:726 (2003).

In animal models of airway hyper-responsiveness, chronic inhalation of ovalbumin by sensitized mice resulted in bronchial eosinophilic inflammation and early induction of IL-17 mRNA expression in inflamed lung tissue, together with a bronchial neutrophilia Hellings, et al. *Am J Respir Cell Mol Biol* 28:42 (2003). Anti-IL-17 monoclonal antibodies strongly reduced bronchial neutrophilic influx but significantly enhanced IL-5 levels in both bronchoalveolar lavage fluid and serum, and aggravated allergen-induced bronchial eosinophilic influx, suggesting that IL-17 may be involved in determining the balance between neutrophil and eosinophil accumulation following antigen insult Id.

Apart from asthma, several chronic inflammatory airway diseases are characterized by neutrophil recruitment in the airways and both IL-17 and IL-23 have been reported to play an important role in the pathogenesis of respiratory conditions such as chronic obstructive pulmonary disease (COPD), bacterial pneumonia and cystic fibrosis (Linden, et al. *Eur Respir J* 15.973 (2000), Ye, et al. *Am J Respir Cell Mol Biol* 25:335 (2001), Rahman, et al. *Clin Immunol* 115:268 (2005); Dubin and Kolls, *Am. J. Physiol. Lung Cell Mol. Physiol.* 292: L519-28 (2007); McAllister et al. *J. Immuno.* 175:404-412 (2005)). An anti-IL-17 and/or anti-IL-23 therapeutic molecule could be demonstrated to be efficacious for chronic inflammatory airway disease in an in vitro model of inflammation. The ability of antagonists to IL-17 and/or IL-23 activity to inhibit IL-17 or and/or IL-23 signalling to induce cytokine and chemokine production from cultured HBECs or bronchial fibroblasts could be used as a measure of efficacy for such antagonists in the prevention of the production of inflammatory mediators directly resulting from IL-17 and/or IL-23 stimulation. If the addition of antagonists to IL-17 and/or IL-23 activity markedly reduces the production and expression of inflammatory mediators, it would be expected to be efficacious in inflammatory aspects associated with chronic airway inflammation.

6. Multiple Sclerosis

Multiple sclerosis is a relatively commonly occurring autoimmune disease characterized by demyelination and chronic inflammation of the central nervous system (CNS). Although the mechanisms underlying disease initiation are not clearly understood, the disease processes that contribute to clinical progression of multiple sclerosis are inflammation, demyelination, and axonal loss, or neurodegeneration. Macrophages and microglia are the main immune cells of the CNS. These cells, as well as T cells, neutrophils, astrocytes, and microglia, can contribute to the immune-related pathology of, e.g., multiple sclerosis. Furthermore, T cell reactivity/autoimmunity to several myelin proteins, including myelin basic protein (MBP), proteolipid protein (PLP), myelin oligodendrocyte protein (MOG), and perhaps other myelin proteins, have been implicated in the induction and perpetuation of disease state and pathology of multiple sclerosis. This interaction of autoreactive T cells and myelin proteins can result in the release of proinflammatory cytokines, including TNF-a, IFN-g, and IL-17, among others. Additional consequences are the proliferation of T cells, activation of B cells and macrophages, upregulation of chemokines and adhesion molecules, and the disruption of the blood-brain barrier. The ensuing pathology is a loss of oligodendrocytes and axons, and the formation of a demyelinated "plaque". The plaque consists of a lesion in which the myelin sheath is now absent and the demyelinated axons are embedded within glial scar tissue. Demyelination can also occur as the result of specific recognition and opsinization of myelin antigens by autoantibodies, followed by complement- and/or activated macrophage-mediated destruction. It is this axonal loss and neurodegeneration that is thought to be primarily responsible for the irreversible neurological impairment that is observed in progressive multiple sclerosis.

There is a large amount of clinical and pathological heterogeneity in the course of human multiple sclerosis. Symptoms most often begin between the ages of 18 and 50 years old, but can begin at any age. The clinical symptoms of multiple sclerosis can vary from mild vision disturbances and headaches, to blindness, severe ataxia and paralysis. The majority of the patients (approximately 70-75%) have relapsing-remitting multiple sclerosis, in which disease symptoms can recur within a matter of hours to days, followed by a much slower recovery; the absence of symptoms during stages of remission is not uncommon. The incidence and frequency of relapses and remissions can vary greatly, but as time progresses, the recovery phases can be incomplete and slow to occur. This worsening of disease in these cases is classified as secondary-progressive multiple sclerosis, and occurs in approximately 10-15% of multiple sclerosis patients. Another 10-15% of patients are diagnosed with primary-progressive multiple sclerosis, in which disease symptoms and physical impairment progress at a steady rate throughout the disease process.

Both IL-23 and IL-17 are overexpressed in the central nervous system of humans with multiple sclerosis and in mice undergoing an animal model of multiple sclerosis, experimental autoimmune encephalomyelitis (EAE). (See Example 11). The overexpression is observed in mice when the EAE is induced by either myelin oligodendrocyte glycoprotein (MOG) 35-55 peptide- or proteolipid peptide (PLP). Furthermore, neutralization of either IL-23/p19 or IL-17 results in amelioration of EAE symptoms in mice (Park et al, *Nat Immunol.* 6:1133 (2005); ); Chen et al, *J Clin Invest.* 116:1317 (2006)).

The ability of antagonists to IL-17 and/or IL-23 activity to inhibit IL-17 or and/or IL-23 signalling-induced cytokine and chemokine production could be used as a measure of efficacy for such antagonists in the treatment of multiple sclerosis. The addition of antagonists to IL-17 and/or IL-23 activity markedly reduces the production and expression of inflammatory mediators (i.e. CNS-infiltrating immune cells; CNS expression of inflammatory cytokines/chemokines, etc.) and symptoms of multiple sclerosis (e.g. paralysis; ataxia; weight loss, etc). See Example 8. These results indicate that antagonists to IL-17 and/or IL-23 activity would be efficacious in the treatment of humans.

7. Cancer

Chronic inflammation has long been associated with increased incidence of malignancy and similarities in the regulatory mechanisms have been suggested for more than a century. Infiltration of innate immune cells, elevated activities of matrix metalloproteases (MMP) and increased angiogenesis and vasculature density are a few examples of the similarities between chronic and tumour-associated inflammation. Conversely, the elimination of early malignant lesions by immune surveillance, which relies on the cytotoxic activity of tumour-infiltrating T cells or intra-epithelial lymphocytes, is thought to be rate-limiting for the risk to develop cancer.

There are numerous publications describing important roles for IL-23 and IL-17 in tumor biology and/or angiogenesis. Both IL-23 and IL-17 have been published to be upregulated in several human tumors and cancers, including but not limited to those of the colon, breast, ovarian, cervical, prostate, lung, and stomach, as well as melanoma and T cell lymphoma (Tartour et al, *Cancer Res.* 59:3698 (1999); Kato et al, *Biochem. Biophys. Re.s Commun.* 282:735 (2001); Steiner et al, *Prostate.* 56:171 (2003); Langowksi et al, *Nature,* 442:461-5, (2006)). Thus, neutralization of both IL-17 and a key upstream regulator of IL-17, IL-23 (via p19), is a potent and effective means of treating cancer and other neoplastic diseases. Therefore, neutralizing both IL-17 and IL-23 with antagonists of the present invention (i.e. a single neutralizing entity or antibody to IL-17 and IL-23 or an antagonistic molecule that will neutralize both together, such as a bispecific antibody or bispecific scFv) will have better efficacy in these diseases than antagonists directed toward either of IL-17 or IL -23 alone.

Angiogenesis refers to the formation of new capillaries from preexisting vessels. There are several reports that angiogenesis plays important roles in hematological malignancies and solid tumors. The initiation of angiogenesis and the switch to the angiogenic phenotype requires a change between proangiogenic factors and angiogenic inhibitors (Folkman, *Nat. Med.* 1:27 (1995)). IL-17 acts as a stimulatory hematopoietic cytokine by initiating proliferation of mature neutrophils and by expanding myeloid progenitors. It has been well documented that IL-17 has pro-angiogenic activities and stimulates the migration of vascular endothelial cells, which are associated with tumor promotion (Numasaki et al, *Blood,* 101:2620 (2003); Yang et al, *J. Biol. Chem.,* 278: 33232 (2003); Fujino et al, *Gut,* 52:65 (2003)). In vitro angiogenic activity can be suppressed by neutralizing IL-17 with a neutralizing anti-IL-17 monoclonal antibody, further supporting the role of IL-17 in this action. It is also able to selectively enhance mitogenic activity of basic fibroblast growth factor (bFGF), hepatocyte growth factor (HGF), and vascular endothelial growth factor (VEGF), and IL-17 may also promote bFGF-, HGF- and VEGF-mediated angiogenesis via bFGF-, HGF- and VEGF-induced growth of vascular endothelial cells (Takahashi et al, *Immunol Lett.* 98:189 (2005)). IL-17 has been reported to augment the secretion of several angiogenic CXC chemokines (e.g. CXCL1, CXCL5, CXCL6, and CXCL8) in non-small cell lung cancer (SCLC) lines. Endothelial cell chemotactic activity (a measure of net angiogenic potential) is increased in response to conditioned medium from NSCLC stimulated with recombinant IL-17. NSCLC lines transfected with IL-17 grew more rapidly versus controls when transplanted in SCID mice (Numasaki et al, *J. Immunol.* 175:6177 (2005)). Furthermore, IL-17 has been reported to be associated with increased IL-6 at the site of tumors and is well reported to increase MMP-9 expression. MMP-9 is an important modulator in diseases of inflammation, autoimmunity, and cancer. These reports, therefore, clearly implicate a pro-angiogenic and tumor promoting action for IL-17. Therefore, neutralizing both IL-17 and IL-23 with antagonists of the present invention (i.e. a single neutralizing entity or antibody to IL-17 and IL-23 or an antagonistic molecule that will neutralize both together, such as a bispecific antibody or bispecific scFv) will have better efficacy than antagonists directed toward either of IL-17 or IL-23 alone.

Similar to IL-17, IL-23 promotes inflammatory responses including upregulation of MMP-9, and is also reported to increase angiogenesis and reduce CD8+ T-cell infiltration. Taken together, these actions can lead to enhanced initiation, progression, and/or maintenance of tumors, cancers, and other transformed growths. That IL-23 plays an important role in cancerous diseases is supported by the observation that neutralization of IL-23 with a monoclonal antibody or with genetic deletion in mice reduces tumor growth in several murine tumor models (Langowksi et al. *Nature,* 442: 461-5 (2006)). Efficacy is associated with reduced IL-17 expression and reductions in IL-17-related tumorogenic biomarkers, such as granulocyte infiltration, G-CSF and MMP-9. Therefore, neutralizing both IL-17 and IL-23 with antagonists of the present invention (i.e. a single neutralizing entity or antibody to IL-17 and IL-23 or an antagonistic molecule that will neutralize both together, such as a bispecific antibody or bispecific scFv) will have better efficacy in these diseases than antagonists directed toward either of IL-17 or IL-23 alone.

8. Irritable Bowel Syndrome (IBS)

Irritable bowel syndrome (IBS) represents a disease characterized by abdominal pain or discomfort and an erratic bowel habit. IBS patients can be characterized into three main groups based on bowel habits: those with predominantly loose or frequent stools, those with predominantly hard or infrequent stools, and those with variable or normal stools (Talley et al., *Expert Opin. Emerg. Drugs* 7:91-8 (2002)). Altered intestinal motility, abnormalities in epithelial function, abnormal transit of stool and gas, and stress, may contribute to symptoms, while visceral hypersensitivity is a key feature in most patients. Genetic factors affecting pain-signaling and disturbances in central processing of afferent signals are postulated to predispose individuals to IBS following specific environmental exposures. Studies have also demonstrated that inflammatory responses in the colon may contribute to increased sensitivity of smooth muscle and enteric nerves and therefore perturb sensory-motor functions in the intestine (Collins et al., *Can. J. Gastroenterol* 15 Suppl B: 14B-16B (2001)). There is clinical overlap between IBS and IBD, with IBS-like symptoms frequently reported in patients before the diagnosis of IBD, and a higher than expected IBS symptoms in patients in remission from established IBD. Thus, these conditions may coexist with a higher than expected frequency, or may exist on a continuum, with IBS and IBD at different ends of the same spectrum. However, it should be noted that in most IBS patients, colonic biopsy specimens appear normal. Nevertheless, IBS significantly affects a very large number of individuals (U.S. prevalence in 2000, approximately 16 million individuals), resulting in a total cost burden of 1.7 billion dollars (year 2000). Thus, among the most prevalent and costly gastrointestinal diseases and disorders, IBS is second only to gastroesophageal reflux disease (GERD). Yet unlike GERD, treatment for IBS remains unsatisfactory ((Talley et al., *Expert Opin. Emerg.*

Drugs 7:91-8 (2002)); Farhadi et al., *Expert Opin. Investig. Drugs* 10:1211-22 (2001); Collins et al., *Can. J. Gastroenterol* 15 Suppl B:14B-16B (2001)), demonstrating that IBS clearly represents an unmet medical need.

Converging disease models have been proposed that postulate an enhanced responsiveness of neural, immune or neuroimmune circuits in the central nervous system (CNS) or in the gut to central (psychosocial) or peripheral (tissue irritation, inflammation, infection) perturbations of normal homeostasis (Talley et al., *Expert Opin. Emerg. Drugs* 7:91-8 (2002)). This enhanced responsiveness results in dysregulation of gut motility, epithelial function (immune, permeability), and visceral hypersensitivity, which in turn results in IBS symptoms.

There may be a role for a number of different molecules in the pathogenesis of IBS including a role for molecules that stimulate neurons and those that are involved in initiation of inflammatory process, including IL-17A and IL-23p19.

Efficacy of inhibitors of these molecules could be tested in vivo in animal models of disease. Several animal models have been proposed that mimic key features of IBS and involve centrally targeted stimuli (stress) or peripherally targeted stimuli (infection, inflammation). Two examples of in vivo animal models that can be used to determine the effectiveness of inhibitors in the treatment of IBS are (i) models focusing on primary CNS-directed pathogeneisis of IBS (stress models), and (ii) models focusing on gut-directed inducers of stress (i.e. gut inflammation, infection or physical stress). It should be noted however, that events within the CNS or in the gastrointestinal (GI) tract do not occur in isolation and that symptoms of IBS most likely result from a complex interaction between signals from the CNS on the GI and vice versa.

Thus, in summary, there are several molecules and pathogenic pathways that are shared by IL-17 and IL-23 which play important roles in the devopment, progression, and maintenance of both autoimmune diseases and cancerous diseases. These include the pro-angiogenic roles of IL-17 and IL-23; enhanced MMP-9 levels and activity by IL-17 and IL-23; IL-23, TGF-b and IL-6-mediated production and/or maintenance of Th17 cells; roles of TGF-b and IL-6 in the generation of Foxp3+ regulatory T cells; and additional pathways and molecules. Therefore, the IL-17/IL-23 axis represents an important link to the inappropriate and pathogenic T cell responses associated with autoimmune diseases, tumour-promoting pro-inflammatory processes, and the failure of the adaptive immune surveillance to infiltrate tumours. Therefore, neutralizing both IL-17 and IL-23 with antagonists of the present invention (i.e. a single neutralizing entity or antibody to IL-17 and IL-23 or an antagonistic molecule that will neutralize both together, such as a bispecific antibody or bispecific scFv) will have better efficacy in these diseases than antagonists directed toward either of IL-17 or IL-23 alone.

J) Pharmaceutical Compositions

For pharmaceutical use, the antibodies of the present invention are formulated for parenteral, particularly intravenous or subcutaneous, delivery according to conventional methods. Intravenous administration will be by bolus injection, controlled release, e.g, using mini-pumps or other appropriate technology, or by infusion over a typical period of one to several hours. In general, pharmaceutical formulations will include a hematopoietic protein in combination with a pharmaceutically acceptable vehicle, such as saline, buffered saline, 5% dextrose in water or the like. Formulations may further include one or more excipients, preservatives, solubilizers, buffering agents, albumin to provent protein loss on vial surfaces, etc. When utilizing such a combination therapy, the cytokines may be combined in a single formulation or may be administered in separate formulations. Methods of formulation are well known in the art and are disclosed, for example, in *Remington's Pharmaceutical Sciences*, Gennaro, ed., Mack Publishing Co., Easton Pa., 1990, which is incorporated herein by reference. Therapeutic doses will generally be in the range of 0.1 to 100 mg/kg of patient weight per day, preferably 0.5-20 mg/kg per day, with the exact dose determined by the clinician according to accepted standards, taking into account the nature and severity of the condition to be treated, patient traits, etc. Determination of dose is within the level of ordinary skill in the art. The proteins will commonly be administered over a period of up to 28 days following chemotherapy or bone-marrow transplant or until a platelet count of $>20,000/mm^3$, preferably $>50,000/mm^3$, is achieved. More commonly, the proteins will be administered over one week or less, often over a period of one to three days. In general, a therapeutically effective amount of antibodies of the present invention is an amount sufficient to produce a clinically significant increase in the proliferation and/or differentiation of lymphoid or myeloid progenitor cells, which will be manifested as an increase in circulating levels of mature cells (e.g. platelets or neutrophils). Treatment of platelet disorders will thus be continued until a platelet count of at least $20,000/mm^3$, preferably $50,000/mm^3$, is reached. The antibodies of the present invention can also be administered in combination with other cytokines such as IL-3, -6 and -11; stem cell factor; erythropoietin; G-CSF and GM-CSF. Within regimens of combination therapy, daily doses of other cytokines are commonly known by one skilled in the art, or can be determined without undue experimentation. Combination therapy with EPO, for example, is indicated in anemic patients with low EPO levels.

Generally, the dosage of administered antibodies will vary depending upon such factors as the patient's age, weight, height, sex, general medical condition and previous medical history. Typically, it is desirable to provide the recipient with a dosage of antibodies which is in the range of from about 1 pg/kg to 10 mg/kg (amount of agent/body weight of patient), although a lower or higher dosage also may be administered as circumstances dictate.

Administration of antibodies of the invention to a subject can be intravenous, intraarterial, intraperitoneal, intramuscular, subcutaneous, intrapleural, intrathecal, by perfusion through a regional catheter, or by direct intralesional injection. When administering therapeutic proteins by injection, the administration may be by continuous infusion or by single or multiple boluses.

Additional routes of administration include oral, mucosal-membrane, pulmonary, and transcutaneous. Oral delivery is suitable for polyester microspheres, zein microspheres, proteinoid microspheres, polycyanoacrylate microspheres, and lipid-based systems (see, for example, DiBase and Morrel, "Oral Delivery of Microencapsulated Proteins," in *Protein Delivery: Physical Systems*, Sanders and Hendren (eds.), pages 255-288 (Plenum Press 1997)). The feasibility of an intranasal delivery is exemplified by such a mode of insulin administration (see, for example, Hinchcliffe and Illum, *Adv. Drug Deliv. Rev.* 35:199 (1999)). Dry or liquid particles comprising antibodies of the invention can be prepared and inhaled with the aid of dry-powder dispersers, liquid aerosol generators, or nebulizers (e.g., Pettit and Gombotz, *TIBTECH* 16:343 (1998); Patton et al., *Adv. Drug Deliv. Rev.* 35:235 (1999)). This approach is illustrated by the AERX diabetes management system, which is a hand-held electronic inhaler that delivers aerosolized insulin into the lungs. Studies have shown that proteins as large as 48,000 kDa have been delivered across skin at therapeutic concentrations with the aid of low-frequency ultrasound, which illustrates the feasibility of trascutaneous administration (Mitragotri et al., *Science* 269: 850 (1995)). Transdermal delivery using electroporation provides another means to administer a molecule having IL-17 and IL-23/p19 binding activity (Potts et al., *Pharm. Biotechnol.* 10:213 (1997)).

A pharmaceutical composition comprising one or more antibodies of the invention can be formulated according to known methods to prepare pharmaceutically useful compositions, whereby the therapeutic proteins are combined in a mixture with a pharmaceutically acceptable carrier. A composition is said to be a "pharmaceutically acceptable carrier" if its administration can be tolerated by a recipient patient. Sterile phosphate-buffered saline is one example of a pharmaceutically acceptable carrier. Other suitable carriers are well-known to those in the art. See, for example, Gennaro (ed.), *Remington's Pharmaceutical Sciences,* 19th Edition (Mack Publishing Company 1995).

For purposes of therapy, antibodies of the invention and a pharmaceutically acceptable carrier are administered to a patient in a therapeutically effective amount. A combination of a therapeutic molecule of the present invention and a pharmaceutically acceptable carrier is said to be administered in a "therapeutically effective amount" if the amount administered is physiologically significant. An agent is physiologically significant if its presence results in a detectable change in the physiology of a recipient patient. For example, an agent used to treat inflammation is physiologically significant if its presence alleviates the inflammatory response. Effective treatment may be assessed in a variety of ways. In one embodiment, effective treatment is determined by reduced inflammation. In other embodiments, effective treatment is marked by inhibition of inflammation. In still other embodiments, effective therapy is measured by increased well-being of the patient including such signs as weight gain, regained strength, decreased pain, thriving, and subjective indications from the patient of better health.

A pharmaceutical composition comprising antibodies of the invention can be furnished in liquid form, in an aerosol, or in solid form. Liquid forms, are illustrated by injectable solutions and oral suspensions. Exemplary solid forms include capsules, tablets, and controlled-release forms. The latter form is illustrated by miniosmotic pumps and implants (Bremer et al., *Pharm. Biotechnol* 10:239 (1997); Ranade, "Implants in Drug Delivery," in *Drug Delivery Systems*, Ranade and Hollinger (eds.), pages 95-123 (CRC Press 1995); Bremer et al., "Protein Delivery with Infusion Pumps," in *Protein Delivery: Physical Systems*, Sanders and Hendren (eds.), pages 239-254 (Plenum Press 1997); Yewey et al., "Delivery of Proteins from a Controlled Release Injectable Implant," in *Protein Delivery: Physical Systems*, Sanders and Hendren (eds.), pages 93-117 (Plenum Press 1997)).

Liposomes provide one means to deliver therapeutic polypeptides to a subject intravenously, intraperitoneally, intrathecally, intramuscularly, subcutaneously, or via oral administration, inhalation, or intranasal administration. Liposomes are microscopic vesicles that consist of one or more lipid bilayers surrounding aqueous compartments (see, generally, Bakker-Woudenberg et al., *Eur. J. Clin. Microbiol. Infect. Dis.* 12 (Suppl. 1):S61 (1993), Kim, *Drugs* 46:618 (1993), and Ranade, "Site-Specific Drug Delivery Using Liposomes as Carriers," in *Drug Delivery Systems*, Ranade and Hollinger (eds.), pages 3-24 (CRC Press 1995)). Liposomes are similar in composition to cellular membranes and as a result, liposomes can be administered safely and are biodegradable. Depending on the method of preparation, liposomes may be unilamellar or multilamellar, and liposomes can vary in size with diameters ranging from 0.02 μm to greater than 10 μm. A variety of agents can be encapsulated in liposomes: hydrophobic agents partition in the bilayers and hydrophilic agents partition within the inner aqueous space(s) (see, for example, Machy et al., *Liposomes In Cell Biology And Pharmacology* (John Libbey 1987), and Ostro et al., *American J. Hosp. Pharm.* 46:1576 (1989)). Moreover, it is possible to control the therapeutic availability of the encapsulated agent by varying liposome size, the number of bilayers, lipid composition, as well as the charge and surface characteristics of the liposomes.

Liposomes can adsorb to virtually any type of cell and then slowly release the encapsulated agent. Alternatively, an absorbed liposome may be endocytosed by cells that are phagocytic. Endocytosis is followed by intralysosomal degradation of liposomal lipids and release of the encapsulated agents (Scherphof et al., *Ann. N.Y. Acad. Sci.* 446:368 (1985)). After intravenous administration, small liposomes (0.1 to 1.0 μm) are typically taken up by cells of the reticuloendothelial system, located principally in the liver and spleen, whereas liposomes larger than 3.0 μm are deposited in the lung. This preferential uptake of smaller liposomes by the cells of the reticuloendothelial system has been used to deliver chemotherapeutic agents to macrophages and to tumors of the liver.

The reticuloendothelial system can be circumvented by several methods including saturation with large doses of liposome particles, or selective macrophage inactivation by pharmacological means (Claassen et al., *Biochim. Biophys. Acta* 802:428 (1984)). In addition, incorporation of glycolipid- or polyethelene glycol-derivatized phospholipids into liposome membranes has been shown to result in a significantly reduced uptake by the reticuloendothelial system (Allen et al., *Biochim. Biophys. Acta* 1068:133 (1991); Allen et al., *Biochim. Biophys. Acta* 1150:9 (1993)).

Liposomes can also be prepared to target particular cells or organs by varying phospholipid composition or by inserting receptors or ligands into the liposomes. For example, liposomes, prepared with a high content of a nonionic surfactant, have been used to target the liver (Hayakawa et al., Japanese Patent 04-244,018; Kato et al., *Biol. Pharm. Bull* 16:960 (1993)). These formulations were prepared by mixing soybean phospatidylcholine, α-tocopherol, and ethoxylated hydrogenated castor oil (HCO-60) in methanol, concentrating the mixture under vacuum, and then reconstituting the mixture with water. A liposomal formulation of dipalmitoylphosphatidylcholine (DPPC) with a soybean-derived sterylglucoside mixture (SG) and cholesterol (Ch) has also been shown to target the liver (Shimizu et al., *Biol Pharm. Bull* 20:881 (1997)).

Alternatively, various targeting ligands can be bound to the surface of the liposome, such as antibodies, antibody fragments, carbohydrates, vitamins, and transport proteins. For example, liposomes can be modified with branched type galactosyllipid derivatives to target asialoglycoprotein (galactose) receptors, which are exclusively expressed on the surface of liver cells (Kato and Sugiyama, *Crit. Rev. Ther. Drug Carrier Syst.* 14:287 (1997); Murahashi et al., *Biol Pharm. Bull.*20:259 (1997)). Similarly, Wu et al., *Hepatology* 27:772 (1998), have shown that labeling liposomes with asialofetuin led to a shortened liposome plasma half-life and greatly enhanced uptake of asialofetuin-labeled liposome by hepatocytes. On the other hand, hepatic accumulation of liposomes comprising branched type galactosyllipid derivatives can be inhibited by preinjection of asialofetuin (Murahashi et al., *Biol Pharm. Bull.*20:259 (1997)). Polyaconitylated human serum albumin liposomes provide another approach for targeting liposomes to liver cells (Kamps et al., *Proc. Nat'l Acad. Sci. USA* 94:11681 (1997)). Moreover, Geho, et al. U.S. Pat. No. 4,603,044, describe a hepatocyte-directed liposome vesicle delivery system, which has specificity for hepatobiliary receptors associated with the specialized metabolic cells of the liver.

In a more general approach to tissue targeting, target cells are prelabeled with biotinylated antibodies specific for a ligand expressed by the target cell (Harasym et al., *Adv. Drug Deliv. Rev.* 32:99 (1998)). After plasma elimination of free antibody, streptavidin-conjugated liposomes are administered. In another approach, targeting antibodies are directly attached to liposomes (Harasym et al., *Adv. Drug Deliv. Rev.* 32:99 (1998)).

Polypeptides and antibodies can be encapsulated within liposomes using standard techniques of protein microencapsulation (see, for example, Anderson et al., *Infect. Immun.* 31:1099 (1981), Anderson et al., *Cancer Res.* 50:1853 (1990), and Cohen et al., *Biochim. Biophys. Acta* 1063:95 (1991), Alving et al. "Preparation and Use of Liposomes in Immunological Studies," in *Liposome Technology*, 2nd Edition, Vol. III, Gregoriadis (ed.), page 317 (CRC Press 1993), Wassef et al., *Meth. Enzymol.* 149:124 (1987)). As noted above, therapeutically useful liposomes may contain a variety of components. For example, liposomes may comprise lipid derivatives of poly(ethylene glycol) (Allen et al., *Biochim. Biophys. Acta* 1150:9 (1993)).

Degradable polymer microspheres have been designed to maintain high systemic levels of therapeutic proteins. Microspheres are prepared from degradable polymers such as poly (lactide-co-glycolide) (PLG), polyanhydrides, poly (ortho esters), nonbiodegradable ethylvinyl acetate polymers, in which proteins are entrapped in the polymer (Gombotz and Pettit, *Bioconjugate Chem.* 6:332 (1995); Ranade, "Role of Polymers in Drug Delivery," in *Drug Delivery Systems*, Ranade and Hollinger (eds.), pages 51-93 (CRC Press 1995); Roskos and Maskiewicz, "Degradable Controlled Release Systems Useful for Protein Delivery," in *Protein Delivery: Physical Systems*, Sanders and Hendren (eds.), pages 45-92 (Plenum Press 1997); Bartus et al., *Science* 281:1161 (1998); Putney and Burke, *Nature Biotechnology* 16:153 (1998); Putney, *Curr. Opin. Chem. Biol.* 2:548 (1998)). Polyethylene glycol (PEG)-coated nanospheres can also provide carriers for intravenous administration of therapeutic proteins (see, for example, Gref et al., *Pharm. Biotechnol* 10:167 (1997)).

The antibody fragments described herein, including scFvs, Fabs, diabodies, etc. can be fused to an entity to extend their half-life. See, for example, Kubetzko S. et al. *J Biol Chem* 281:35186 (2006) [Modified p185Her2 (Her2)-specific scFv 4D5 and measured binding affinity, functional affinity, tumor distribution, and PK. In tumor-bearing mice, 20 kD PEGylation of the scFv monomer and dimer extended serum half-life and tumor distribution.]; Yang K et al. *Protein Engineering* 16:761 (2003) [A 20 kD or 40 kD-PEGylated anti-TNF-a scFv (D2E7/Humira) retained affinity for target and pharmacological activity. Following iv administration in mice, 40 kD PEGylated scFv had a 200-fold increased circulating half-life and an 800-fold increased AUC as compared to the unmodified scFv.]; Chapman A P et al. Nature Biotech 17:780 (1999). [Fab utilized in the experiments exploring affinities and half-life of random versus targeted PEG attachment and different sizes of the PEG molecule. Demonstrates site-specific attachment of PEG moieties to the hinge region cysteine residue results in higher binding affinities for target as compared to randomly attached PEGs. Binding affinity as measured by Biacore analysis was identical for parent Ig and the Fab molecules modified by attachment of 5 kD, 25 kD and branched 40 kD PEGs. 25 kD and 40 kD-PEGylated Fabs had a comparable or increased half-life and an AUC of 50-70% of that of the parent Ig molecule in mice and monkeys]; Muller D et al. J Biol Chem 282:12650 (2007). [Fused human serum albumin (HSA) to several bispecific antibodies to carcinoembryonic antigen (CEA) and CD3 and compared activity and pharmacokinetics. scFv2, scDb, and taFv (constructs shown in paper) fused to HSA retained full binding capacity and activity. Half-life in serum of the HSA constructs increased 5-11-fold and the AUC increased 6-7-fold compared to their respective unmodified parent molecule]; and Kipriyanov S M et al. J Mol Biol 293:41 (1999). [Anti-CD3/CD-19 tandem diabody molecule demonstrated to have higher affinity, slower dissociation, higher stability in serum, higher in vivo stability, and longer in vivo half-life as compared to a single chain Fv fragments and diabodies.]

The present invention also contemplates chemically modified polypeptides having binding IL-17 and IL-23 activity such as anti-IL-17A and IL-23/p19 antibodies, which a polypeptide is linked with a polymer, as discussed above.

Other dosage forms can be devised by those skilled in the art, as shown, for example, by Ansel and Popovich, *Pharmaceutical Dosage Forms and Drug Delivery Systems*, $5^{th}$ Edition (Lea & Febiger 1990), Gennaro (ed.), *Remington's Pharmaceutical Sciences*, $19^{th}$ Edition (Mack Publishing Company 1995), and by Ranade and Hollinger, *Drug Delivery Systems* (CRC Press 1996).

As an illustration, pharmaceutical compositions may be supplied as a kit comprising a container that comprises an antibody of the invention. Antibodies of the invention can be provided in the form of an injectable solution for single or multiple doses, or as a sterile powder that will be reconstituted before injection. Alternatively, such a kit can include a drypowder disperser, liquid aerosol generator, or nebulizer for administration of a therapeutic polypeptide. Such a kit may further comprise written information on indications and usage of the pharmaceutical composition. Moreover, such information may include a statement that the antibody composition is contraindicated in patients with known hypersensitivity to IL-17 and IL-23.

A pharmaceutical composition comprising antibodies of the invention can be furnished in liquid form, in an aerosol, or in solid form. Liquid forms, are illustrated by injectable solutions, aerosols, droplets, topological solutions and oral suspensions. Exemplary solid forms include capsules, tablets, and controlled-release forms. The latter form is illustrated by miniosmotic pumps and implants (Bremer et al., *Pharm. Biotechnol.* 10:239 (1997); Ranade, "Implants in Drug Delivery," in *Drug Delivery Systems*, Ranade and Hollinger (eds.), pages 95-123 (CRC Press 1995); Bremer et al., "Protein Delivery with Infusion Pumps," in *Protein Delivery: Physical Systems*, Sanders and Hendren (eds.), pages 239-254 (Plenum Press 1997); Yewey et al., "Delivery of Proteins from a Controlled Release Injectable Implant," in *Protein Delivery: Physical Systems*, Sanders and Hendren (eds.), pages 93-117 (Plenum Press 1997)). Other solid forms include creams, pastes, other topological applications, and the like.

Liposomes provide one means to deliver therapeutic polypeptides to a subject intravenously, intraperitoneally, intrathecally, intramuscularly, subcutaneously, or via oral administration, inhalation, or intranasal administration. Liposomes are microscopic vesicles that consist of one or more lipid bilayers surrounding aqueous compartments (see, generally, Bakker-Woudenberg et al., *Eur. J. Clin. Microbiol. Infect. Dis.* 12 (Suppl. 1):S61 (1993), Kim, *Drugs* 46:618

(1993), and Ranade, "Site-Specific Drug Delivery Using Liposomes as Carriers," in *Drug Delivery Systems*, Ranade and Hollinger (eds.), pages 3-24 (CRC Press 1995)). Liposomes are similar in composition to cellular membranes and as a result, liposomes can be administered safely and are biodegradable. Depending on the method of preparation, liposomes may be unilamellar or multilamellar, and liposomes can vary in size with diameters ranging from 0.02 µm to greater than 10 µm. A variety of agents can be encapsulated in liposomes: hydrophobic agents partition in the bilayers and hydrophilic agents partition within the inner aqueous space(s) (see, for example, Machy et al., *Liposomes In Cell Biology And Pharmacology* (John Libbey 1987), and Ostro et al., *American J. Hosp. Pharm.* 46:1576 (1989)). Moreover, it is possible to control the therapeutic availability of the encapsulated agent by varying liposome size, the number of bilayers, lipid composition, as well as the charge and surface characteristics of the liposomes.

Liposomes can adsorb to virtually any type of cell and then slowly release the encapsulated agent. Alternatively, an absorbed liposome may be endocytosed by cells that are phagocytic. Endocytosis is followed by intralysosomal degradation of liposomal lipids and release of the encapsulated agents (Scherphof et al., *Ann. N.Y. Acad. Sci.* 446:368 (1985)). After intravenous administration, small liposomes (0.1 to 1.0 µm) are typically taken up by cells of the reticuloendothelial system, located principally in the liver and spleen, whereas liposomes larger than 3.0 µm are deposited in the lung. This preferential uptake of smaller liposomes by the cells of the reticuloendothelial system has been used to deliver chemotherapeutic agents to macrophages and to tumors of the liver.

The reticuloendothelial system can be circumvented by several methods including saturation with large doses of liposome particles, or selective macrophage inactivation by pharmacological means (Claassen et al., *Biochim. Biophys. Acta* 802:428 (1984)). In addition, incorporation of glycolipid- or polyethelene glycol-derivatized phospholipids into liposome membranes has been shown to result in a significantly reduced uptake by the reticuloendothelial system (Allen et al., *Biochim. Biophys. Acta* 1068:133 (1991); Allen et al., *Biochim. Biophys. Acta* 1150:9 (1993)).

Liposomes can also be prepared to target particular cells or organs by varying phospholipid composition or by inserting receptors or ligands into the liposomes. For example, liposomes, prepared with a high content of a nonionic surfactant, have been used to target the liver (Hayakawa et al., Japanese Patent 04-244,018; Kato et al., *Biol. Pharm. Bull* 16:960 (1993)). These formulations were prepared by mixing soybean phospatidylcholine, α-tocopherol, and ethoxylated hydrogenated castor oil (HCO-60) in methanol, concentrating the mixture under vacuum, and then reconstituting the mixture with water. A liposomal formulation of dipalmitoylphosphatidylcholine (DPPC) with a soybean-derived sterylglucoside mixture (SG) and cholesterol (Ch) has also been shown to target the liver (Shimizu et al., *Biol Pharm. Bull.* 20:881 (1997)).

Alternatively, various targeting ligands can be bound to the surface of the liposome, such as antibodies of the present invention, antibody fragments, carbohydrates, vitamins, and transport proteins. For example, liposomes can be modified with branched type galactosyllipid derivatives to target asialoglycoprotein (galactose) receptors, which are exclusively expressed on the surface of liver cells (Kato and Sugiyama, *Crit. Rev. Ther. Drug Carrier Syst.* 14:287 (1997); Murahashi et al., *Biol Pharm. Bull.* 20:259 (1997)). Similarly, Wu et al., *Hepatology* 27:772 (1998), have shown that labeling liposomes with asialofetuin led to a shortened liposome plasma half-life and greatly enhanced uptake of asialofetuin-labeled liposome by hepatocytes. On the other hand, hepatic accumulation of liposomes comprising branched type galactosyl-lipid derivatives can be inhibited by preinjection of asialofetuin (Murahashi et al., *Biol Pharm. Bull* 20:259 (1997)). Polyaconitylated human serum albumin liposomes provide another approach for targeting liposomes to liver cells (Kamps et al., *Proc. Nat'l Acad. Sci. USA* 94:11681 (1997)). Moreover, Geho, et al. U.S. Pat. No. 4,603,044, describe a hepatocyte-directed liposome vesicle delivery system, which has specificity for hepatobiliary receptors associated with the specialized metabolic cells of the liver.

In a more general approach to tissue targeting, target cells are prelabeled with biotinylated antibodies specific for a ligand expressed by the target cell (Harasym et al., *Adv. Drug Deliv. Rev.* 32:99 (1998)). After plasma elimination of free antibody, streptavidin-conjugated liposomes are administered. In another approach, targeting antibodies are directly attached to liposomes (Harasym et al., *Adv. Drug Deliv. Rev.* 32:99 (1998)).

The antibodies of the invention can be encapsulated within liposomes using standard techniques of protein microencapsulation (see, for example, Anderson et al., *Infect. Immun.* 31:1099 (1981), Anderson et al., *Cancer Res.* 50:1853 (1990), and Cohen et al., *Biochim. Biophys. Acta* 1063:95 (1991), Alving et al. "Preparation and Use of Liposomes in Immunological Studies," in *Liposome Technology*, 2nd Edition, Vol. III, Gregoriadis (ed.), page 317 (CRC Press 1993), Wassef et al., *Meth. Enzymol.* 149:124 (1987)). As noted above, therapeutically useful liposomes may contain a variety of components. For example, liposomes may comprise lipid derivatives of poly(ethylene glycol) (Allen et al., *Biochim. Biophys. Acta* 1150:9 (1993)).

Degradable polymer microspheres have been designed to maintain high systemic levels of therapeutic proteins. Microspheres are prepared from degradable polymers such as poly (lactide-co-glycolide) (PLG), polyanhydrides, poly (ortho esters), nonbiodegradable ethylvinyl acetate polymers, in which proteins are entrapped in the polymer (Gombotz and Pettit, *Bioconjugate Chem.* 6:332 (1995); Ranade, "Role of Polymers in Drug Delivery," in *Drug Delivery Systems*, Ranade and Hollinger (eds.), pages 51-93 (CRC Press 1995); Roskos and Maskiewicz, "Degradable Controlled Release Systems Useful for Protein Delivery," in *Protein Delivery: Physical Systems*, Sanders and Hendren (eds.), pages 45-92 (Plenum Press 1997); Bartus et al., *Science* 281:1161 (1998); Putney and Burke, *Nature Biotechnology* 16:153 (1998); Putney, *Curr. Opin. Chem. Biol.* 2:548 (1998)). Polyethylene glycol (PEG)-coated nanospheres can also provide carriers for intravenous administration of therapeutic proteins (see, for example, Gref et al., *Pharm. Biotechnol.* 10:167 (1997)).

Other dosage forms can be devised by those skilled in the art, as shown, for example, by Ansel and Popovich, *Pharmaceutical Dosage Forms and Drug Delivery Systems*, 5$^{th}$ Edition (Lea & Febiger 1990), Gennaro (ed.), *Remington's Pharmaceutical Sciences*, 19$^{th}$ Edition (Mack Publishing Company 1995), and by Ranade and Hollinger, *Drug Delivery Systems* (CRC Press 1996).

The present invention contemplates antagonists of IL-17 and IL-23 and methods and therapeutic uses comprising an such antagonists as described herein. Such compositions can further comprise a carrier. The carrier can be a conventional organic or inorganic carrier. Examples of carriers include water, buffer solution, alcohol, propylene glycol, macrogol, sesame oil, corn oil, and the like.

The invention is further illustrated by the following non-limiting examples.

EXAMPLES

Example 1

Binding of Human IL-17 to Human IL-17R

A) Binding of Biotinylated IL-17 to Cells Transfected with the Cognate IL-17 Receptor (IL-17R)

Baby Hamster Kidney (BHK) cells that had been transfected with expression vectors encoding human IL-17R (polynucleotide shown in SEQ ID NO:7; polypeptide shown in SEQ ID NO:8) were assessed for their ability to bind biotinylated human IL-17. Cells were harvested with versene, counted and diluted to $10^7$ cells per ml in staining media (SM), which was HBSS plus 1 mg/ml bovine serum albumin (BSA), 10 mM Hepes, and 0.1% sodium azide (w/v). Biotinylated human IL-17 (SEQ ID NO:2) were incubated with the cells on ice for 30 minutes at various concentrations. After 30 minutes, excess cytokine was washed away with SM and the cells were incubated with a 1:100 dilution of streptavidin conjugated to phycoerythrin (SA-PE) for 30 minutes on ice. Excess SA-PE was washed away and cells were analyzed by flow cytometry. The amount of cytokine binding was quantitated from the mean fluorescence intensity of the cytokine staining. Results demonstrate that human IL-17 binds to human IL-17R-tranfected cells with high affinity.

B) Inhibition of Specific Binding of Biotinylated Human IL-17 with Unlabeled Cytokine Binding studies were performed as discussed above, but excess unlabeled human IL-17 was included in the binding reaction, as well as excess unlabeled IL-17B, IL-17C, IL-17D, IL-17E and IL-23. In studies with BHK cells, the amount of unlabeled cytokine was varied over a range of concentrations and we find that addition of unlabeled human IL-17 competed for binding of human IL-17 to human IL-17R-transfected cell, indicating that human IL-17 specifically binds to human IL-17R; the other IL-17 family cytokines tested (B, C, D, E, and F) were not able to compete for binding, further supporting the specificity of IL-17 for IL-17R and the use of this assay for testing antagonistic binding of IL-17 with an antibody.

C) Inhibition of Specific Binding of Biotinylated Human IL-17 with an Anti-Human IL-17 Antagonist Binding studies were performed as discussed above, except that a range of concentrations of an antagonist of the present invention (i.e. an antibody) to human IL-17 was included in the binding reactions. We find that the anti-human IL-17 antibody inhibits binding of human IL-17 to human IL-17R-transfected BHK cells, indicating that the anti-human IL-17 antibody was effective at blocking the binding of IL-17 to its receptor. Isotype-matched negative control antibodies and antibodies to IL-17 cytokine family members other than IL-17 were unable to block the binding of human IL-17 to IL-17RA-transfected cells, indicating that the action of the anti-human IL-17 antibody was specific for human IL-17.

Example 2

Murine Nih3t3 Cells Respond to Human IL-17

A) Cell Plating and kz142 Adenovirus Reporter Infection

Nih3t3 cells, derived from mouse fibroblasts were plated at 5000 cells/well in solid white, cell culture coated 96 well plates, (Cat. #3917. Costar) using DMEM/10% FBS, containing glutamine and amended with pyruvate and cultured overnight at 37° C. and 5% C02. On this second day, the plating media was removed and Kz142 adenovirus particles at a multiplicity of infection of 5000 particles/cell were prepared in DMEM/1% FBS, containing glutamine and amended with pyruvate and cultured overnight at 37° C. and 5% C02.

B) Luciferase Assay Measuring IL-17 Activation of kz142 Adenovirus Reporter Infected nih3t3 Cells Following the overnight incubation with the adenovirus particle reporter, human IL-17 ligand treatments were prepared in "serum-free" media, amended to 0.28% BSA. The adenovirus particles and media were removed and the appropriate ligand doses were given in triplicates. Incubation at 37° C. and 5% C02 was continued for 4 hours, after which the media was removed, cells lysed for 15 minutes and mean fluorescence intensity (MFI) measured using the luciferase assay system and reagents. (Cat.#e1531 Promega. Madison, Wis.) and a Microplate luminometer. Activity was detected at concentrations ranging from 0.1-1000 ng/mL human IL-17, generating EC50 values of about 50 ng/L. These data suggest that nih3t3 cells carry receptors for human IL-17 and that IL-17 activates the NfKb/Ap-1 transcription factor, thus providing an appropriate cell line for testing IL-17-mediated activity and use of an antibody to augment this activity.

Example 3

Murine Nih3t3 Cells Express Human IL-17 Receptor (IL-17R)

RTPCR analysis of nih3t3 RNA demonstrated that these cells are positive for human IL-17R, consistent with their nfkb/ap1 response to human IL-17 being mediated through this receptor.

A) Mouse IL-17R PCR

First strand cDNA was prepared from total RNA isolated from nih3t3 cells using standard methods. PCR was applied using hot start polymerase and the manufacturer's recommendations (Qiagen, Valencia, Calif.) using sense primer, zc38520 (SEQ ID NO:9) and antisense primer, zc 38521 (SEQ ID NO:10) and 35 cycles of amplification. Agarose gel electrophoresis revealed a single, robust amplicon of the expected, 498 bp size.

Example 4

Creation of a Stable Nih3t3 Assay Clone Expressing the ap1/nfkb Transcription Factor The murine nih3t3 cell line described above was stably transfected with the kz142 ap1/nfkb reporter construct, containing a neomycin-selectable marker. The Neo resistant transfection pool was plated at clonal density. Clones were isolated using cloning rings and screened by luciferase assay using the human IL-17 ligand as an inducer. Clones with the highest mean fluorescence intensity (MFI) (via ap1/NfkB luciferase) and the lowest background were selected. A stable transfectant cell line was selected and called nih3t3/kz142.8.

Example 5

Inhibition of Activation by Human IL-17 in Murine Nih3t3 Cells Using an Antagonist to Human IL-17

Antibodies or other IL-17A neutralizing entities to human IL-17 were used as antagonists of human IL-17 activation of ap1/nfkb elements in a luciferase assay. In this assay, anti-human IL-17 antibodies or neutralizing entities inhibit EC50 levels of human IL-17-mediated ap1nfkb activation in the murine nih3t3/kz142.8 assay cell line. For highly effective antibodies, when used at approx. 10 μg/mL concentration, the antibody completely neutralized activity induced by human IL-17, with the inhibition of activity decreasing in a dose dependent fashion at the lower concentrations. An isotype-matched negative control mAb, tested at the concentrations described above, provided no inhibition of activity. These results demonstrate that antibodies and other neutralizing entities to IL-17 are able to antagonize the activity of the pro-inflammatory cytokines, IL-17. Inhibition in this assay was not observed when anti-human antibodies to other ligand members of the IL-17 family, besides IL-17, were added instead of the anti-human IL-17 antibody or neutralizing entities. Table 6 below shows representative example data for the ability of neutralizing IL-17A antagonist positive controls, and anti-IL-17A neutralizing entities described herein. The data demonstrate that these neutralizing entities are able to reduce the activity induced by human IL-17A.

TABLE 6

| cluster id | | IC50 (nM) |
|---|---|---|
| | IL17A poly Ab | 2 |
| | IL-17RA-Fc | 1.3 |
| | IL-17A Fab Clone | |
| c87 (SQ7) | M7.19 E7 | 7.2 |
| c86 (SQ7) | M7.19 D10 | 7.7 |
| c97 (SQ7) | M7.20 G6 | 28 |
| c95 (SQ7) | M7.20 E5 | 105 |
| c100 (SQ7) | M7.24 G6 | 31 |
| c99 (SQ7) | M7.24 E8 | 84.0 |
| c83 (SQ7) | M7.19 F4 | 100.0 |
| c98 (SQ7) | M7.24 E5 | >130 |
| c88 (SQ7) | M7.24 A5 | 96.0 |
| c94 (SQ7) | M7.20 C10 | >130 |
| c96 (SQ7) | M7.20 F11 | 37.0 |
| c90 (SQ7) | M7.20 A9 | 113.0 |
| | IL-17A scFv | |
| c222.1 | M7.76_C08 | 33 |

Example 6

Neutralization of IL-17 Activity by an Anti-Human IL-17 Antibody

Using a cell-based neutralization assay, a purified anti-human IL-17 antibody was added as a serial dilution, for example, at 10 μg/ml, 5 μg/ml, 2.5 μg/ml, 1.25 μg/ml, 625 ng/ml, 313 ng/ml, 156 ng/ml and 78 ng/ml. The assay plates were incubated at 37° C., 5% $CO_2$ for 4 days at which time Alamar Blue (Accumed, Chicago, Ill.) was added at 20 μl/well. Plates were again incubated at 37° C., 5% $CO_2$ for 16 hours. This assay is able to demonstrate that the purified anti-human monoclonal antibody was able neutralize signaling of human IL-17. For highly effective antibodies, when used at approx. 10 μg/mL concentration, the antibody completely neutralizes proliferation induced by human IL-17, with the inhibition of proliferation decreasing in a dose dependent fashion at the lower concentrations. An isotype-matched negative control mouse mAb, tested at the concentrations described above, was expected to provide no inhibition of proliferation of either cytokine. These results further demonstrate that antibodies to IL-17 could indeed antagonize the activity of the pro-inflammatory ligands, IL-17. Inhibition in this assay was not observed when anti-human antibodies to other ligand members of the IL-17 family, besides IL-17, are added instead of the anti-human IL-17 antibody, thus demonstrating IL-17A specificity.

Example 7

A Single Neutralizing Entity to IL-17 and IL-23 Decreases Inflammation and Inflammatory Mediators in an Ex Vivo Multiple Sclerosis Model Multiple sclerosis is a complex disease that is thought to be mediated by a number of factors, including the presence of lymphocytic and mononuclear cell inflammatory infiltrates and demyelination throughout the CNS. Microglia are macrophage-like cells that populate the central nervous system (CNS) and become activated upon injury or infection. Microglia have been implicated as playing critical roles in various CNS diseases including multiple sclerosis, and may be used to study mechanism(s) of initiation, progression, and therapy of the disease (Nagai et al. *Neurobiol. Dis.* 8:1057 (2001); Olson et al. *J Neurosci Methods* 128:33 (2003)). Immortalized human microglial cell lines and/or established human astroglia cell lines can, therefore, be used to study some of the effects of inflammatory mediators on these cell types and their potential for neutralization. Inflammatory mediators (including, but not limited to IL-1b, IL-6, IL-8, IL-12, IL-13, IL-15, IL-17 A and F, IL-18, IL-23, TNF-a, IFN-g, MIP family members, RANTES, IP-10, MCP-1, G- and GM-CSF, etc.) can contribute to the symptoms and pathology associated with MS by way of their effect(s) on activating inflammatory pathways and downstream effector cells.

In order to evaluate the pro-inflammatory actions of IL-17 and IL-23, and the ability of an antagonist to these activities, such as molecules that bind IL-17 and IL-23, either singly or together, or antibodies thereto including the IL-17/IL-23 antibodies of the present invention to neutralize or decrease these effects, cultured glial cells may be treated with one of the following: vehicle; rhIL-17; rhIL-23; or any of the compounds known to induce an inflammatory response by microglial and/or astroglia cells (e.g. LPS, other TLR agonists, inflammatory cytokines, etc.) In addition, these are treated with or without an antagonist of either IL-17 or IL-23, alone or in combination. After varying times in culture (from 1 h to several days), supernatants and cells are collected and analyzed for levels and/or expression of inflammatory mediators, including those listed above. Levels of inflammatory cytokines and chemokines are elevated in the presence of rhIL-17 and/or IL-23 and/or other inflammatory stimulants compared to cultures treated with vehicle alone. The addition of antagonists to IL-17 and/or IL-23 activity, such as the antibodies of the present invention markedly reduces the production and expression of inflammatory mediators, and thus, would expect to be efficacious in inflammatory aspects associated with human multiple sclerosis.

Example 8

Neutralizing Entities to IL-17 and IL-23 Decreases Disease Incidence and Progression in Mouse Experimental Allergic Encephalomyelitis (EAE) as a Model of Multiple Sclerosis A) Mouse Allergic Encephalomyelitis (EAE) Model To study mechanism and evaluate the effects of potential therapies for multiple sclerosis, the animal model of experimental autoimmune encephalomyelitis (EAE) is commonly used. For the relapsing-remitting EAE model, 9 to 10 week old female SJL mice (Jackson or Charles River Labs) were immunized subcutaneously with proteolipid peptide (PLP) emulsified in complete Freund's adjuvant, and with intravenous pertussis toxin. Within approximately 6 to 23 days, animals begin to show symptoms of weight loss and paralysis that are characteristic of this model. The extent of disease is evaluated daily in the mice by taking their body weights and assigning a clinical score (0-8) to each mouse, as detailed below. The typical pattern of disease symptoms in immunized, but otherwise untreated mice, is one of weight loss and paralysis, followed by a period of disease symptom remission, and a subsequent relapse of disease symptoms. A pattern of relapses and remissions of disease symptoms ensues, which is also found in humans with this type of multiple sclerosis, known as relapsing-remitting disease. Chronic progressive and secondary progressive multiple sclerosis are also targeted indications for this therapeutic combination of IL-17 and IL-23/p19 neutralizing antibodies or a single neutralizing entity such as a bispecific antibody or scFV as described in this invention. These latter types of multiple sclerosis are tested in a similar manner using MOG35-55 peptide in C57BL/6 mice, instead of PLP in SJL mice.

Neutralizing monoclonal antibodies to mouse IL-17 and IL-23p19 were administered separately or as a therapeutic combination, during remission from the first peak of EAE disease symptoms. The antibodies were delivered as intraperitoneal injections every other day, or as a similar dosing regimen. Groups receive either 25, 50 or 100 µg of each antibody, alone or as a therapeutic combination, per animal per dose, and control groups receive the vehicle control, PBS (Life Technologies, Rockville, Md.) or antibody isotype control.

B) Monitoring Disease

Animals can begin to show signs of paralysis and weight loss between approximately 6 and 23 days following PLP or MOG35-55 immunizations. Most animals develop symptoms within 11-17 days of the immunizations, but some may show symptoms sooner or later than this.

All animals are observed, weighed, and assigned a clinical score daily to assess the status of disease.

C) Clinical Score
  0=Normal; healthy.
  1=slight tail weakness (tip of tail does not curl and)
  2=tail paralysis (unable to hold tail upright)
  3=tail paralysis and mild waddle
  4=tail paralysis and severe waddle
  5=tail paralysis and paralysis of one limb
  6=tail paralysis and paralysis of any 2 limbs
  7=tetraparesis (all 4 limbs paralysed)
  8=moribund or dead Blood is collected throughout the experiment to monitor serum levels of cytokine and levels of other mediators of disease. At the time of euthanasia, blood was collected for serum, and brain and spinal cord collected in 10% NBF for histology. In separate animals, tissues (including lymph nodes, brain, spinal cord, spleen, and others) were harvested for the quantification of mRNA by TaqMan quantitative real-time PCR.

D) Results

Groups of mice (n=13-15 each) receiving the therapeutic combination of neutralizing monoclonal antibodies to IL-17 and IL-23/p19 were characterized by a significant ($p<0.05$) reduction in disease severity as evidenced by significant ($p<0.05$) reductions in clinical score and body weight loss compared to mice treated with PBS, either of the antibodies alone at similar doses as those used in the combination, or isotype control antibodies. Furthermore, the mice treated with the therapeutic antibody combination had a complete absence of disease relapse, whereas all other treatment groups had 35-85% of mice experiencing significant disease relapse. Therefore, the delivery of the therapeutic combination was significantly more efficacious in reducing active disease and importantly, in preventing disease relapse, than the delivery of either monoclonal antibody alone at similar doses. This is a very important finding since disease relapse is a hallmark of this disease model and of relapsing-remitting MS in humans. There was extensive infiltration of inflammatory cells into the CNS parenchyma for mice treated with only the PBS or isotype control antibody. The greatest overall reduction of inflammatory cell infiltrates in the CNS of mice were those treated with the therapeutic combination of neutralizing monoclonal antibodies to IL-17 and IL23/p19. Treatment with these therapeutic antibodies also resulted in significant reductions in serum IL-6, IL-113, IL-17A, IL-23, G-CSF, and TNF-a concentrations compared to PBS-treated mice. Samples were collected at the same time point following peak of first disease onset (day 27) and after the same number of antibody doses (11 doses). Draining lymph nodes were harvested from the mice at this same time point and cultured for 24 h with PLP139-151. Mice treated with the therapeutic antibody combination had a lower percentage of TNF-a containing draining lymph node cells compared to other groups of mice. Thus, the significant reductions in disease severity and disease relapse in the mice treated with the antibody combination were associated with reductions in CNS inflammatory infiltrates and inflammatory cytokine production, suggesting a mechanism of action for the observed efficacy.

Taken together, these results indicate that the therapeutic combination of IL-17 and IL23/p19 neutralizing antibodies is more efficacious in the treatment of EAE as a model of human multiple sclerosis. The therapeutic combination can reduce clinical disease symptoms and works at the molecular level to reduce inflammation, inflammatory infiltrates, inflammatory cytokines/chemokines, and other mechanisms known to be affected in this manner.

Example 9

Cell-Based Bioassay to Evaluate Activity of a Anti-Mouse IL-23/p19 to Mouse IL-23

In an effort to develop a bioassay for use in testing IL-23 neutralizing antibodies, an IL-3-dependent mouse cell line expressing human DCRS2 (IL-23R, SEQ ID NO: 22) was tested with recombinant mouse IL-23 in a proliferation assay to determine whether the human DCRS2 receptor along with endogenously expressed mouse IL-12RB1 can bind mouse IL-23 and cause cell signaling and proliferation. Once the ability of mouse IL-23 to bind human DCRS2 was established, a second proliferation assay was run with mouse IL-23 and a monoclonal antibody to mouse IL-23/p19 to determine its ability to specifically neutralize mouse IL-23/p19.

A) Construction of BaF3 Cells Expressing Full-Length DCRS2

The BaF3 assay cell line was a previously utilized cell line and was chosen for use in these assays because it expresses human DCRS2. A previously utilized BaF3 cell line that does not express human DCRS2 was selected for use as a negative control. The assay cell line was constructed by sequentially placing an expression vector (pZP7Z) containing human WSX1 and an expression vector (pZP7NX) containing human DCRS2 into BaF3 cells. These expression vectors and subsequent cell lines were built using the following steps.

B) Cloning of Full Length DCRS2

In U.S. patent application No. WO 00/73451, Dowling L M et al described an orphan Class I cytokine receptor designated DCRS2 (SEQ ID NO:22) possessing a very short cytoplasmic domain such that it did not appear to be competent to signal if bound by its cognate ligand. In an effort to discover additional isoforms possessing cytoplasmic domains with classical signaling elements, a PCR, 3'rapid amplification of cDNA ends (RACE) cloning strategy was initiated.

In order to identify cDNA template sources containing DCRS2 transcript, a collection of cDNA libraries were screened by PCR using zc38188 (SEQ ID NO:11) and zc38247 (SEQ ID NO:12). These oligos were used in a PCR reaction at a concentration of 0.2 pmol per uL, with Advantage II thermostable DNA polymerase and buffer (Clontech, Palo Alto, Calif.), dNTPs at 0.125 mM and 40 ng per uL of cDNA library plasmid template. Following a 3 minute preincubation at 94° C. known as a "hotstart", the reactions underwent 30 thermal cycles of 94° C., 30 seconds and 68° C., 90 seconds. Reaction products were analyzed by TAE, agarose gel elecrophoresis and ethidium bromide staining, and observed from the following cDNA libraries: human adrenal, human bone marrow, human activated CD3+ T cell, and human testis. These products were isolated, sequenced and confirmed to be DCRS2. As these DCRS2-containing cDNA templates were directionally cloned, plasmid libraries; 3'RACE could be done using "nested" oligo primers complimentary to the plasmid sequence downstream of the 3' cDNA cloning site. Primary 3'RACE PCR reactions were run using the same reaction components as above but with zc 38188 (SEQ ID NO: 11) and zc 26405 (SEQ ID NO: 13) and the four, DCRS2-positive cDNA libraries as templates. The products of these reactions were purified using a Qiaquick PCR purification kit, (Qiagen, Valencia, Calif.) following the manufacturer's recommended protocol. The purified PCR products underwent a secondary amplification using PCR primers, zc 38248 (SEQ ID NO:14), and zc 5020 (SEQ ID NO:15) whose complimentary sequences lie within the expected DCRS2-plamid PCR product obtained with zc 38188 (SEQ ID NO:11) and zc 38247 (SEQ ID NO:12), and thus are so called "nested primers". The thermal cycling conditions of these reactions began with a hot start preincubation and continued with 30 cycles of 94° C., 30 seconds; 64° C., 20 seconds; 71° C., 70 seconds. Products were gel-purified and sequenced directly using the same amplifying primers. Sequence analysis revealed an extended cytoplamic domain containing putative box 1, 2 and 3 STAT binding motifs. The risk of these sequences containing mutations randomly introduced by PCR with AdvantageII over 60 cycles of amplification prompted repeating the PCRs using a thermostable polymerase known to have higher fidelity and thus a lower mutation rate.

In this second round of 3' RACE, the 5' primers were complimentary to vector sequence upstream of the cDNA cloning site while the 3' primers were designed based upon the sequence obtained from the 3'RACE products described above. Eight identical reactions were set up and run with a range of temperatures, 66-57° C., in the annealing step of the thermal cycle. Turbo Pfu1 polymerase (Stratagene, LaJolla, Calif.) and its buffer along with dNTPs at 0.125 mM, 40 ng per uL human adrenal cDNA template, zc 14063 (SEQ ID NO:16) and zc 38777 (SEQ ID NO:17) after a hotstart went through 30 thermal cycles of: 94° C., 30 seconds; annealing 35 seconds; 72° C., 130 seconds. The products of these reactions were purified away from unincorporated primers using a Qiaquick PCR purification kit, (Qiagen, Valencia, Calif.).

These products were then utilized as templates in a "nested" PCR reaction. Five identical, parallel reactions were assembled as above for each template using zc 38776 (SEQ ID NO:18) and zc38188 (SEQ ID NO:11) with each reaction varying slightly in the annealing temperatures, 59, 62, 63.5, 65, 66° C. A DNA product of approximately 1800 bp was visualized in all reactions that utilized a template originating from a 57° C. primary reaction. by ethidium bromide staining following TAE agarose gel electrophoresis.

To facilitate the cloning of this PCR product into a mammalian expression vector prior to sequencing, restriction sites were added through the use of oligonucleotides and a third round of PCR with Turbo Pfu. Zc 38776 (SEQ ID NO:18) which contains an XhoI site, was mixed with zc 38246 (SEQ ID NO:19) in addition to the dNTPs, polymerase, buffer and 1800 bp PCR product obtained above and following a hot start, incubated for 30 cycles of 95° C., 30 seconds; 55° C., 40 seconds; 72° C., 150 seconds. The sequence of zc38776 matches the 5' end of zc38188 but also includes a BamHI site and Kozak concensus sequence. The resulting PCR product was purified using a Qiaquick mini-elute kit (Qiagen, Valencia, Calif.) and prepared for cloning into a mammalian expression vector by digestion with BamHI and XhoI restriction enzymes for 90 minutes at 37° C. The mammalian expression vector pZP7NX was similarly digested with BamHI and XhoI to prepare it for acceptance of the full-length DCRS2 cDNA. Both digestions underwent TAE gel electrophoresis, appropriate fragments were harvested and purified using a Qiaquick gel extraction kit (Qiagen, Valencia, Calif.) following the manufacturers recommendations. Approximately 40 ng of BamHI/XhoI digested pZP7NX and 10 ng of BamHI/XhoI digested DCRS2 were ligated together using 0.25U T4 DNA ligase (Invitrogen, Carlsbad, Calif.) and incubated at 22° C. for 4 hours. One uL of the ligation reaction was then electoporated into 25 uL of Electromax DH10b cells (Invitrogen, Carlsbad, Calif.) using a Genepulser electroporation apparatus (Biorad, Hercules, Calif.) set to 2.3 Kv, 100 ohms and 25 uF. After plating serial dilutions of the electroporation on LB-ampicillin agar plates, clones were isolated and confirmed to be full-length with one silent mutation by sequence analysis (SEQ ID NO:22). A large scale plasmid prep was made and this plasmid was utilized for various mammalian cell transfections.

BaF3, an IL-3-dependent prelymphoid cell line derived from murine bone marrow (Palacios and Steinmetz, *Cell* 41. 727 (1985); Mathey-Prevot et al., *Mol. Cell Biol* 6: 4133 (1986)), was maintained in complete media (RPMI medium; JRH Bioscience Inc., Lenexa, Kans.) supplemented with 10% heat-inactivated fetal calf serum, 2 ng/mL murine IL-3 (R&D, Minneapolis, Minn.), 2 mM L-glutamine (Gibco-BRL), and 1 mM sodium pyruvate (Gibco-BRL).

BaF3 cells were prepared for electroporation by washing twice in RPMI medium (JRH Bioscience Inc., Lenexa, Kans.) and then resuspending in RPMI at a cell density of $10^7$ cells/ml. One mL of resuspended BaF3 cells was mixed with 30 μg of the pZP7Z/h.WSX1 plasmid DNA and transferred to separate disposable electroporation chambers (Gibco-BRL). The cells were then given 2 serial shocks (800 1Fad/300V; 1180 1Fad/300V.) delivered by an electroporation apparatus (CELL-PORATOR™; Gibco-BRL, Bethesda, Md.). The electroporated cells were subsequently transferred to 20 mls of complete media and placed in an incubator for 24 hours (37° C., 5% $CO_2$). The cells were then spun down and resuspended in 20 mLs of complete media containing 240 μg/mL Zeocin (Invitrogen, Carlsbad, Calif.) selection in a T-75 flask to isolate the Zeocin resistant pool. The resulting stable cell line was called BaF3/WSX1.

BaF3/WSX1 cells were prepared for electroporation by washing twice in RPMI medium (JRH Bioscience Inc., Lenexa, Kans.) and then resuspending in RPMI at a cell density of $10^7$ cells/mL. One mL of resuspended BaF3 cells was mixed with 30 μg of the pZP7NX_DCRS2 plasmid DNA and transferred to separate disposable electroporation chambers (Gibco-BRL). The cells were then given 2 serial shocks (800 1Fad/300V; 1180 1Fad/300V.) delivered by an electroporation apparatus (CELL-PORATOR™; Gibco-BRL, Bethesda, Md.). The electroporated cells were subsequently transferred to 20 mls of complete media containing 240 μg/mL Zeocin (Invitrogen, Carlsbad, Calif.) and placed in an incubator for 24 hours (37° C., 5% $CO_2$). The cells were then spun down and resuspended in 20 mLs of complete media containing 1× G418 (Gibco-BRL, Bethesda, Md.) and 240 μg/mL Zeocin (Invitrogen, Carlsbad, Calif.) selection in a T-75 flask to isolate the G418 resistant pool. The resulting stable cell line was called BaF3 WSX1/DCRS2.

C) Construction of Baf3/KZ134 Cell Line

The negative control cell line, BaF3/KZ134, was constructed using the following steps. The KZ134 plasmid was constructed with complementary oligonucleotides ZC12749 (SEQ ID NO:20) and ZC12748 (SEQ ID NO:21) that contain STAT transcription factor binding elements from 4 genes, which includes a modified c-fos S is inducible element (m67SIE, or hSIE) (Sadowski, et al., *Science* 261: 1739 (1993)) the p21 SIE1 from the p21 WAF1 gene (Chin et al., *Science* 272: 719 (1996)), the mammary gland response element of the γ-casein gene (Schmitt-Ney et al., *Mol Cell Biol* 11:3745 (1991)), and a STAT inducible element of the Fcγ RI gene, (Seidel et al., *Proc. Natl. Acad. Sci.* 92:3041 (1995)). These oligonucleotides contain Asp718-XhoI compatible ends and were ligated, using standard methods, into a recipient firefly luciferase reporter vector with a c-fos promoter (Poulsen et al., *J. Biol. Chem.* 273:6229 (1998)) digested with the same enzymes and containing a neomycin selectable marker. The KZ134 plasmid was used to stably transfect BaF3 cells, using standard transfection and selection methods, to make the BaF3/KZ134 cell line.

D) Alamar Blue Proliferation Assay to Determine Species Specificity of IL-23 on BaF3 Cells Expressing Human DCRS2

To determine whether human DCRS2 and mouse IL-12RB1 endogenously expressed in murine BaF3 cells can bind mouse IL-23, and perhaps human IL-23, an Alamar Blue proliferation assay was run. Recombinant human IL-23 (R&D Systems, Cat.#1290-IL) and mouse IL-23 (R&D Systems, Cat.# 1887-ML) were run at concentrations of 200, 100, 50, 25, 12.5, 6.3, and 3.1 ng/mL. A positive control of mouse IL-3 was run at concentrations of 20, 10, 5, 2.5, 1.25, 0.6, 0.3, and 0.15 pg/mL. Negative controls were run in parallel using mouse IL-3-free media only. Samples were plated into 96-well flat-bottomed plates (Bectin-Dickinson, Franklin Lakes, N.J.) in a volume of 100 μL. The cells were washed 3 times in IL-3 free media and counted using a hemocytometer. Cells were resuspended in IL-3-free media and plated at a concentration of 5000 cells per well in 100 μL into the plate containing the samples for total well volume of 200 μL. The assay plates are incubated at 37° C., 5% $CO_2$ for 3 days at which time Alamar Blue (Accumed, Chicago, Ill.) is added at 20 μL/well. Alamar Blue gives a fluorometric readout based on number of live cells, and thus is a direct measurement of cell proliferation in comparison to a negative control. Plates are again incubated at 37° C., 5% $CO_2$ for 24 hours. Plates are read on the Wallac 1420 microplate reader (PerkinElmer Life Sciences, Boston, Mass.) at wavelengths 544 (Excitation), and 590 (Emission).

Results show that both human and mouse IL-23 cause similar proliferative responses on the BaF3 WSX1/DCRS2 cell line. Human and mouse IL-23 were negative on the BaF3/KZ134 cell line, which shows that the response is limited to the presence of DCRS2 expression. A second BaF3 cell line expressing human DCRS2 was also tested and was found to proliferate in response to human and mouse IL-23, similar to the BaF3 WSX1/DCRS2 cell line.

E) Alamar Blue Proliferation Assay to Determine Effects of a Neutralizing Antibody to Mouse IL-23/p19 on BaF3 Cells Expressing Human DCRS2

Another proliferation assay was run to test the ability of an antibody to neutralize mouse IL-23. The antibody tested was rat anti-mouse IL-23/p19 clone G23-8 (Cat.#16-723285, eBioscience, San Diego, Calif.). Mouse IL-23 concentrations of 10, 5, 2.5, 1.25, 0.6, 0.3, 0.15, and 0.08 ng/mL were run. In order to determine whether the anti-IL-23/p19 antibody was specific for the p19 sub-unit and did not cross-react with the IL-12/23p40 subunit, a range of recombinant mouse IL-23p40 concentrations (up to 200 ng/mL) was also tested. Concentrations of the anti-mouse IL-23/p19 antibody were run at 10, 5, 2.5, 1.25, 0.6, 0.3, 0.15, and 0.08 ug/mL, and a negative control antibody, Rat IgG1 anti-mouse CD115 (Cat. #MCA1848, Serotec, Raleigh, N.C.) was also run at the same dilutions as the anti-mouse IL-23/p19 antibody. Mouse IL-23 was added to each well containing either the anti-mouse IL-23/p19 antibody or mouse CD 115 antibody for a final concentration of 1.5 ng/mL mouse IL-23. Wells without antibody were also set up with mouse IL-23 at 1.5 ng/mL, which is approximately 80% of the maximum IL-23 response. A positive control of mouse IL-3 was run at concentrations of 20, 10, 5, 2.5, 1.25, 0.6, 0.3, and 0.15 pg/mL. Negative controls were run in parallel using mouse IL-3-free media only. Samples were plated into 96-well flat-bottomed plates (Bectin-Dickinson, Franklin Lakes, N.J.) in a volume of 100 μL.

The cells were washed 3 times in IL-3-free media and counted using a hemocytometer. Cells were resuspended in IL-3-free media and plated at a concentration of 5000 cells per well in 100 μL into the plate containing the samples for a final well volume of 200 μL. The assay plates were incubated at 37° C., 5% $CO_2$ for 3 days at which time Alamar Blue (Accumed, Chicago, Ill.) was added at 20 μL/well. Alamar Blue gives a fluorometric readout based on number of live cells, and thus is a direct measurement of cell proliferation in comparison to a negative control. Plates were again incubated at 37° C., 5% $CO_2$ for 24 hours. Plates were read on the Wallac 1420 microplate reader (PerkinElmer Life Sciences, Boston, Mass.) at wavelengths 544 (Excitation), and 590 (Emission).

The results show that the anti-mouse IL-23/p19 antibody neutralized the mouse IL-23 proliferative response in a dose-dependent manner. There was no neutralization of the recombinant mouse IL-112/IL-23p40, thus indicates that the anti-mouse IL-23/p19 antibody is specific for the p19 subunit of IL-23. The CD 115 antibody slightly inhibits the proliferative response at the highest concentration only. These assays show that the human DCRS2 receptor can cause signaling with mouse IL-23 in a BaF3 proliferation assay system and can be used to screen neutralizing antibodies to mouse IL-23. Furthermore, these results demonstrate that the anti-mouse IL-23/p19 antibody is specific to the p19 subunit of mouse IL-23.

Example 10

Cell-Based Bioassay to Evaluate Neutralizing Activity of an Anti-Human IL-23/p19 to Human IL-23

In an effort to develop a bioassay for use in testing human IL-23/p19 neutralizing antibodies, an IL-3-dependent mouse cell line expressing human DCRS2 (IL-23R, SEQ ID NO: 22) was tested with recombinant human IL-23 in a proliferation assay to determine whether the human DCRS2 receptor along with endogenously expressed mouse IL-12RB1 can bind human IL-23 and cause cell signaling and proliferation. As shown in Example 9 above, the cell line and resulting bioassay was found to be appropriate for the testing of both mouse and human IL-23 activity and IL-23 neutralizing activity. Therefore, once the ability of human IL-23 to bind human DCRS2 was established, as shown in that example, a second proliferation assay was run with human IL-23 and a monoclonal antibody to human IL-23/p19 to determine its ability and specificity to neutralize human IL-23/p19.

A) Construction of BaF3 Cells Expressing Full-Length DCRS2 and Construction of Baf3/KZ134 Cell Line The BaF3 assay cell line was a previously utilized cell line and was chosen for use in these assays because it expresses human DCRS2. A previously utilized BaF3 cell line that does not express human DCRS2 was selected for use as a negative control. The assay cell line was constructed by sequentially placing an expression vector (pZP7Z) containing human WSX1 and an expression vector (pZP7NX) containing human DCRS2 into BaF3 cells. These expression vectors and subsequent cell lines were built using the steps outlined in Example 9. The negative control cell line, BaF3/KZ134, was constructed using the steps outlined in Example 9.

B) Alamar Blue Proliferation Assay to Determine Effects of a Neutralizing Antibody to Human IL-23/p19 on BaF3 cells Expressing Human DCRS2

Another proliferation assay was run to test the ability of an antibody to neutralize human IL-23, via IL-23/p19. Recombinant human IL-23 concentrations of 10, 5, 2.5, 1.25, 0.6, 0.3, 0.15, and 0.08 ng/mL were run. In order to determine whether the anti-IL-23/p19 antibody was specific for the p19 subunit and did not cross-react with the IL-12/IL-23p40 subunit, a range of recombinant human IL-12 concentrations (up to 200 ng/mL) was also tested. Concentrations of the anti-human IL-23/p19 antibody were run at 10, 5, 2.5, 1.25, 0.6, 0.3, 0.15, and 0.08 ug/mL, and a negative control antibody was also run at the same dilutions as the anti-human IL-23/p19 antibody. Human IL-23 was added to each well containing either the anti-human IL-23/p19 antibody or negative control antibody for a final concentration of 1.5 ng/mL human IL-23. Wells without antibody were also set up with human IL-23 at 1.5 ng/mL, which is approximately 80% of the maximum IL-23 response. A positive control of human IL-3 was run at concentrations of 20, 10, 5, 2.5, 1.25, 0.6, 0.3, and 0.15 pg/mL. Negative controls were run in parallel using human IL-3-free media only. Samples were plated into 96-well flat-bottomed plates (Bectin-Dickinson, Franklin Lakes, N.J.) in a volume of 100 µL.

The cells were washed 3 times in IL-3-free media and counted using a hemocytometer. Cells were resuspended in IL-3-free media and plated at a concentration of 5000 cells per well in 100 µL into the plate containing the samples for a final well volume of 200 µL. The assay plates were incubated at 37° C., 5% $CO_2$ for 3 days at which time Alamar Blue (Accumed, Chicago, Ill.) was added at 20 µL/well. Alamar Blue gives a fluorometric readout based on number of live cells, and thus is a direct measurement of cell proliferation in comparison to a negative control. Plates were again incubated at 37° C., 5% $CO_2$ for 24 hours. Plates were read on the Wallac 1420 microplate reader (PerkinElmer Life Sciences, Boston, Mass.) at wavelengths 544 (Excitation), and 590 (Emission).

The results show that the anti-human IL-23/p19 antibody neutralizes the human IL-23 proliferative response in a dose-dependent manner. There was no neutralization of the exogenously added recombinant human IL-12, thus indicating that the anti-human IL-23/p19 antibody is specific for the p19 subunit of IL-23. Therefore, these results demonstrate that the human DCRS2 receptor can cause signaling with human IL-23 in a BaF3 proliferation assay system and can be used to screen neutralizing antibodies to mouse IL-23. Furthermore, these results demonstrate that the anti-human IL-23/p19 antibody is specific to the p19 subunit of IL-23.

Example 11

Murine IL23/p19 and IL-17 mRNAs are Regulated in Select Tissues in a Murine Model of Experimental Allergic Encephalomyelitis (EAE) Compared to Non-Diseased Controls Tissues were obtained from mice at the peak of disease onset in the PLP EAE model. The model was performed following standard procedures of immunizing female SJL mice with PLP139-151, as described in Example 8 above, in the presence or absence of pertussis toxin, and included appropriate unimmunized, non-diseased controls. Tissues that were collected included brain, spinal cord and cervical lymph nodes. RNA was isolated from all tissues using standard procedures. In brief, tissues were collected and immediately frozen in liquid N2 and then transferred to −80° C. until processing. For processing, tissues were placed in Qiazol reagent (Qiagen, Valencia, Calif.) and RNA was isolated using the Qiagen Rneasy kit according to manufacturer's recommendations. Expression of murine IL23/p19 and IL-17 mRNAs were measured with multiplex real-time quantitative RT-PCR method (TaqMan) and the ABI PRISM 7900 sequence detection system (PE Applied Biosystems). IL23/p19 and IL-17 mRNA levels were normalized to the expression of the murine hypoxanthine guanine physphoribosyl transferase mRNA and determined by the comparative threshold cycle method (User Bulletin 2; PE Applied Biosystems). The primers and probe for murine IL23/p19 included forward primer 5' gcctgagttctagtcagcagtg, reverse primer 5' tggaggcttcgaaggatct, and probe cagcgccccccttctccgttcc. The primers and probe for murine IL-17 included forward primer 5' gctccagaaggccctcaga, reverse primer 5' agctttccctccgcattga, and probe ctctccaccgcaatgaagaccctga. The results were as follows:

1) Murine IL23/p19 mRNA expression was detected in all tissues tested including brain, spinal cord and cervical lymph nodes;

2) Murine IL23/p19 mRNA levels were increased approximately 2.2-fold in the spinal cord of mice immunized with PLP compared to unimmunized controls;

3) Murine IL-17 mRNA expression was detected at very low levels in the lymph nodes and below the level of detection in the brain and spinal cord of unimmunized, control mice;

4) Murine IL-17 mRNA levels were increased approximately 104-fold in the brain tissue of mice immunized with PLP compared to unimmunized controls;

5) Murine IL-17 mRNA levels were increased approximately 695-fold in the spinal cord of mice immunized with PLP compared to unimmunized controls; and 6) Murine IL-17 mRNA levels were increased approximately 1.9-fold in the cervical lymph nodes of mice immunized with PLP compared to unimmunized controls.

Because there are significantly higher levels of both IL-17 and IL-23/p19 in the CNS of mice (i.e. as measured in the same mice) with PLP-induced relapsing-remitting EAE, this further supports the need to antagonize both of these cytokines in multiple sclerosis. Thus, antagonists of the present invention have a therapeutic advantage over IL-17 or IL-23 treatment alone.

Example 12

IL-17 and IL-23/p19 are Overexpressed in Tissues from Mice with Collagen Induced Arthritis (CIA) Compared to Tissue from Non-diseased Mice A) Experimental Protocol Tissues were obtained from mice with varying degrees of disease in the collagen-induced arthritis (CIA) model. The model was performed following standard procedures of immunizing male DBA/1J mice with collagen in complete Freund's adjuvant (CFA) in the tail, followed 3 weeks later by similar immunizations, but with collagen in incomplete Freund's adjuvant (IFA). Non-diseased age- and gender-matched DBA/1J mice were also included for comparison. Tissues isolated included affected paws. RNA was isolated from the tissues using standard procedures. In brief, tissues were collected and immediately frozen in liquid N2 and then transferred to −80° C. until processing. For processing, tissues were placed in Qiazol reagent (Qiagen, Valencia, Calif.) and RNA was isolated using the Qiagen Rneasy kit according to manufacturer's recommendations. Expression of murine IL-17 and IL-23/p19 mRNA was measured with multiplex real-time quantitative RT-PCR methods (TaqMan) and the ABI PRISM 7900 sequence detection system (PE Applied Biosystems). Murine IL-17 and IL-23/p19 mRNA levels were normalized to the expression of murine hypoxanthine guanine physphoribosyl transferase mRNA and determined by the comparative threshold cycle method (User Bulletin 2: PE Applied Biosystems). The primers and probe for murine IL-17 and IL-23/p19 were the same as described in Example 11.

B) Results

Murine IL-17 and IL-23/p19 mRNA expression was detected in the tissues tested. Both IL-17 and IL-23/p19 mRNA were increased in the paws from mice in the CIA model of arthritis compared to tissues obtained from non-diseased controls. Murine IL-17 mRNA was increased in the paws approximately 8-fold in mice with more mild disease and approximately 9.3-fold in mice with more severe disease compared to non-diseased controls. Murine IL-23/p19 mRNA was increased in the paws approximately 2.4-fold in mice with more mild disease and approximately 2.1-fold in mice with more severe disease compared to non-diseased controls.

Because there are significantly higher levels of both IL-17 and IL-23/p19 in the affected paws of mice (i.e. as measured in the same mice) with CIA, this further supports the need to antagonize both of these cytokines in rheumatoid arthritis.

Example 13

IL-17 and IL-23/p19 are Overexpressed in Tissues from Mice with DSS-Induced Colitis Compared to Tissue from Non-diseased Mice A) Experimental Protocol Tissues were obtained from mice in the dextran sodium sulfate (DSS) model of colitis. The model was performed following standard procedures of administering 1.5-2.5% DSS in the drinking water of female C57BL/6 mice for 5-7 days (acute protocol), followed by cycles of regular water and DSS water (chronic protocol). Non-diseased age- and gender-matched C57BL/6 mice were also included for comparison. Tissues isolated included the descending colon and proximal colon. RNA was isolated from the tissues using standard procedures. In brief, tissues were collected and immediately frozen in liquid N2 and then transferred to −80° C. until processing. For processing, tissues were placed in Qiazol reagent (Qiagen, Valencia, Calif.) and RNA was isolated using the Qiagen Rneasy kit according to manufacturer's recommendations. Expression of murine IL-17 and IL-23/p19 mRNA was measured with multiplex real-time quantitative RT-PCR methods (TaqMan) and the ABI PRISM 7900 sequence detection system (PE Applied Biosystems). Murine IL-17 and IL-23/p19 mRNA levels were normalized to the expression of murine hypoxanthine guanine physphoribosyl transferase mRNA and determined by the comparative threshold cycle method (User Bulletin 2: PE Applied Biosystems). The primers and probe for murine IL-17 and IL-23/p19 were the same as described in Example 11.

B) Results

Murine IL-17 and IL-23/p19 mRNA expression was detected in the tissues tested. Both IL-17 and IL-23/p19 mRNA were increased in the descending and proximal colon from mice in the acute and chronic DSS colitis model, compared to tissues obtained from non-diseased controls. Murine IL-17 mRNA was increased approximately 50-fold in the descending colon and approximately 180-fold in the proximal colon of mice treated acutely with DSS compared to non-diseased controls. With chronic DSS treatment, IL-17 mRNA levels were approximately 21- and 22-fold higher in the descending and proximal colon, respectively, compared to non-diseased controls. Murine IL-23/p19 mRNA was increased approximately 2-fold in the descending colon and approximately 4.4-fold in the proximal colon of mice treated acutely with DSS compared to non-diseased controls. With chronic DSS treatment, IL-23/p19 mRNA levels were approximately 1.5- and 2-fold higher in the descending and proximal colon, respectively, compared to non-diseased controls. Because there are significantly higher levels of both IL-17 and IL-23/p19 in the colons of mice (i.e. as measured in the same mice) with DSS colitis, this further supports the need to antagonize both of these cytokines in inflammatory bowel disease.

Example 14

Bioassay for Neutralization of Human IL-23 mediated IL-17A and IL-17F Production in Murine Splenocytes Recombinant human IL-23 (rhIL-23) induced the production of IL-17A and IL-17F in murine splenocytes. To evaluate antagonists to IL-23, we examined the neutralization of IL-17A and IL-17F production in rhIL-23 treated murine splenocytes. Antagonists to rhIL-23 are compared to the commercial neutralizing antibody anti-IL-112p40 (Pharmingen, Franklin Lakes, N.J.).

Experimental Protocol:

A single cell suspension of splenocytes were prepared from whole spleens harvested from either C57BL/6 or BALB/c mice. After red blood cell lysis with ACK buffer (0.010 M KHCO3, 0.0001 M EDTA, 0.150 M NH4Cl), splenocytes were washed and resuspended in RPMI buffer (containing 1% non-essential amino acids, 1% Sodium Pyruvate, 2.5 mM HEPES, 1% L-glutamine, 0.00035% 2-mercaptoethanol, 1% Pen/Strep, 10% FCS and 50 ng/ml human IL-2 (R&D Systems, Minneapolis, Minn.)). Cells were seeded at 500,000 cells per well in a 96-well round bottom plate. In a separate plate, rhIL-23 at a concentration of 10 μM was pre-incubated for 30-90 minutes at 37° C. with 3-fold serial dilutions of the antagonists listed in Table 7. Concentrations of the antagonists range from 0-343 nM. The IL-23 ligand plus antagonists were then added to the splenocytes and incubated at 37° C., 5% CO2 for 24-72 hours. The supernatants were collected and frozen at −80° C. until ready to process. The levels of IL-17A and IL-17F protein in the supernatants were measured using bead-based sandwich ELISAs. A commercial kit (Upstate, Charlottesville, Va.) was used to measure IL-17A protein. A bead-based ELISA developed in-house using an antibody to IL-17F (R&D) conjugated to a bead was used to measure IL-17F. IC50 values for each antagonist were calculated as the amount of antagonist needed to neutralize 50% of the activity of rhIL-23.

Results:

In the presence of rhIL-23, the antagonists described in Table 7 were efficacious at reducing IL-17A and IL-17F production with IC50 values of 0.27-100.0 nM.

TABLE 7

IC50 values measured in the murine splenocyte assay.

| Antagonist | Cluster number | IC50 for neutralizing IL-17A | IC50 for neutralizing IL-17F |
|---|---|---|---|
| Anti-IL12p40 (Pharmingen) | | 0.27 nM | 0.4 nM |
| Anti-IL23p19 polyAb (R&D) | | 28 nM | 30 nM |
| IL23RA-Fc (ZGI) | | 10 nM | 43 nM |
| M7.12_B09 (Fab) | c41 (SQ7) | 27 nM | 100 nM |
| M7.36_B06 (scFv) | c305 (SQ22) | 3.3 nM | 14 nM |

Example 15

Plate-Based Binding Assay for IL-17A

Materials and Methods:

Costar (#9018) 96-well plates were coated with 50 ul IL-17A (made in-house) or IL-17F (made in-house) at 2 ug/ml in 0.1M NaHCO$_3$, pH 9.6 overnight at 4° C. The next day, plates were washed three times with 0.1% Tween-20/PBS (PBST). Each well was filled with 350 ul of 2% milk (#170-6404, Bio-Rad)/PBST for one hour at RT for blocking. Assay plates were then washed three times with PBST. Each well was filled with 50 ul of 2% milk/PBST, followed by the addition of 25 ul of Fab or scFv supernatant. Wells were then mixed and then incubated for one hour at RT. Plates were washed three times with PBST. For Fab detection, 50 ul of (1:4000) anti-Human Fab specific pAb-HRP (#31482, Pierce) in 2% milk/PBST was added to each well for one hour at RT. For scFv detection, 50 ul of (1:4000) anti-His tag mAb-HRP (Sigma, #A7058) in 2% milk/PBST was added to each well for one hour at RT. Plates were then washed three times with PBST. 50 ul of TMB (TMBW-1000-01, BioFX Laboratories) was added to each well to develop for 20-30 min, followed by the addition of 50 ul of stop buffer (STPR-1000-01, BioFX Laboratories) to quench the reaction. Plates were then read at 450 nm on a plate reader. Wells that showed greater binding on the plate coated with IL-17A than on the plate coated with IL-17F were chosen for further analysis and manipulation.

Example 16

Plate-Based Binding Assay for IL-23

Materials and Methods:

Costar (#9018) 96-well plates were coated with 50 ul IL-23 (made in-house) or IL-12 (#219-IL/CF, R&D Systems) at 4 ug/ml in 0.1M NaHCO$_3$, pH 9.6, overnight at 4° C. The next day, plates were washed three times with 0.1% Tween-20/PBS (PBST). Each well was filled with 350 ul of 2% milk (#170-6404, Bio-Rad)/PBST for one hour at RT for blocking. Assay plates were then washed three times with PBST. Each well was filled with 50 ul of 2% milk/PBST, followed by the addition of 25 ul of Fab or scFv supernatant. Well were mixed and then incubated for one hour at RT. Plates were washed three times with PBST. For Fab detection, 50 ul of (1:4000) anti-Human Fab specific pAb-HRP (#31482, Pierce) in 2% milk/PBST was added to each well for one hour at RT. For scFv detection, 50 ul of (1:4000) anti-His tag mAb-HRP (Sigma, #A7058) in 2% milk/PBST was added to each well for one hour at RT. Plates were washed three times with PBST. 50 ul of TMB (TMBW-1000-01, BioFX Laboratories) added to each well to develop for 20-30 min, followed by the addition of 50 ul of stop buffer (STPR-1000-01, BioFX Laboratories) to quench the reaction. Plates were then read at 450 nm on a plate reader.

Wells that showed greater binding on the plate coated with the IL-23 heterodimer than on the plate coated with the IL-12 heterodimer were chosen for further analysis and manipulation.

Example 17

Plate-Based Neutralization Assay for IL-17A

Materials and Methods:

Costar (#9018) 96-well plates were coated with 50 ul of anti-human IgG Fcγ-specific antibody (#109-005-098, Jackson Immunology) at 1 ug/ml in 0.1M NaHCO3, pH 9.6 overnight at 4oC. The next day, plates were washed three times with 0.1% Tween-20/PBS (PBST). 50 ul of IL-17RA (made in-house) at 0.25 ug/ml in PBS was added to each well, followed by a one-hour incubation at room temperature (RT). Plates were then washed three times with PBST. Each well was filled with 350 ul of 2% milk (#170-6404, Bio-Rad)/PBST for one hour at RT for blocking. During plate blocking, adjacent plates were set up for pre-incubation of biotinylated IL-17A with Fab or scFv supernatant. Pre-incubation plates were filled with 75 ul of Fab supernatant, followed by the addition of 25 ul of IL-17A (made in-house) at 0.10 ug/ml in 4% milk/PBST. Each well was mixed and then incubated for

Example 18

Plate-Based Neutralization Assay for IL-23

Materials and Methods:

Costar (#9018) 96-well plates were coated with 50 ul of anti-human IgG Fcγ-specific antibody (#109-005-098, Jackson Immunology) at 1 ug/ml in 0.1M NaHCO3, pH 9.6 overnight at 4oC. The next day, plates were washed three times with 0.1% Tween-20/PBS (PBST). 50 ul of IL-23R (#1400-1R-050, R&D Systems) at 0.25 ug/ml in PBS was added to each well, followed by a one-hour incubation at room temperature (RT). Plates were then washed three times with PBST. Each well was filled with 350 ul of 2% milk (#170-6404, Bio-Rad)/PBST for one hour at RT for blocking. During plate blocking, adjacent plates were set up for pre-incubation of biotinylated IL-23 with Fab or scFv supernatant. Pre-incubation plates were filled with 75 ul of Fab or scFv supernatant, followed by the addition of 25 ul of IL-23 heterodimer or p19 (made in-house) at 0.10 ug/ml in 4% milk/PBST. Each well was mixed and then incubated for 30 min at RT. Assay plates were then washed three times with PBST, and the volume of the supernatant/IL-23 complex transferred from the pre-incubation plate to the assay plate, followed by a one-hour incubation at RT. Plates were then washed three times with PBST. 50 ul of (1:3000) Streptavidin-HRP (#21124, Pierce) in PBST added to each well to incubate for one hour. Plates then washed three times with PBST. 50 ul of TMB (TMBW-1000-01, BioFX Laboratories) added to each well to develop for 20-30 min, followed by the addition of 50 ul of stop buffer (STPR-1000-01, BioFX Laboratories) to quench the reaction. Plates were then read at 450 nm on a plate reader.

Example 19

IL-17 and IL-23/p19 are Overexpressed in Tissues from Mouse Model of T-cell Adoptive Transfer Colitis Compared to Tissue from Non-diseased Mice T-cell Adoptive Transfer Colitis Model Adoptive transfer of naive T cells into minor histocompatibility mismatched or syngeneic immunocompromised mice leads to development of colitis (Leach M W et al 1996, Powrie F et al, 1997) as well as skin lesions resembling psoriasis (Schon M P et al 1997, Davenport C M et al 2002). Transplantation of as low as 0.2 million CD4+ CD25− T cells from Balb/C mice into immunocompromised C.B-17 SCID mice results in weight loss, hemoccult positive stool and development of skin lesions (the symptoms in these mice vary from colony to colony). These symptoms normally arise in mice between 7-10 weeks after transplantation.

This model of colitis has some similarities to human Crohn's disease and has been used extensively to test efficacy of therapeutics for this disease in humans. For this experiment, mice (10 Balb/C females, 20 CB17 SCID female) were obtained from CRL. Mice were on tap water starting on day −6. Spleens from 10 Balb/C mice will be collected. CD4+ CD25− T-cell will be collected from pooled spleen (see below for methods). CB17 SCID mice will receive either 5×10^5 or 7.5×10^5 CD4+ CD25' T-cells from spleen via i.v. injection. All mice are weighed 3× week and carefully observed for weight loss. When weight loss is observed, the Disease Activity Index (DAI) score [stool consistency, body weight, and blood in stool] are measured. Any animal with DAI score of 4 or body weight loss of greater than 20% are euthanized. There are no whole splenocytes control.

For LPS/IL-12 accelerated psoriasis, CB17 SCID mice will receive 5×10$^5$ CD4+ CD25− T-cells from spleen via i.v. injection. On day 0, 7, and 14, mice are treated with 20 ug of LPS (from *salmonella*) and 10 ng of rm IL-12 in 100 ul i.p. injection. All mice are weighed 3× week and carefully observed for weight loss. When ear thickening is observed, ear thickness are measured 3× week. Mice are carefully monitored for signs of psoriasis (hair loss, scratching, alopecia, etc). Treatment groups were as follows: Colitis: (Group I) received 0.5 mil CD4+ CD25 cells, with a N of 6 and (Group II) received 0.75 mil CD4+ CD25 cells, with a N of 6. Psoriasis (Group III) received 0.5 mil CD4+ CD25 cells, with a N of 4.

For histology, the distal part of small intestine and entire colon are collected in 10% NBF then transfer to 70% ETOH after 24 hours. Samples are submitted for histological evidence of colitis including presence of granuloma. For GEMS, MLN, distal part of small intestine, proximal colon and distal colon are collected and snap frozen in liquid nitrogen.

CD4+ CD25−T-cell isolation: Balb/C mice are sacrificed by CO2 asphyxiation and spleens are removed and single cell suspensions made. CD4 T cells are enriched by using a sterile magnetic enrichment protocol. CD4+ CD25−T cells are further enriched using a sterile magnetic enrichment protocol or by sorting using a cell sorter. Purity of T-cells are evaluated by flow.

Adoptive Transfer of CD4+ CD25−T cells into SCID mice: Immunocompromised C.B-17 SCID mice were injected i.v. with either 0.5 or 0.75 million enriched CD4+ CD25− T cells on d0. Colitis animals were sacrificed. Mice started to show sign of BW loss around day 15. On day 21, mice were observed with soft stool and diarrhea and were sacrificed. Mice were bled for serum via retro-orbital bleed then euthanized by cervical dislocation. An entire intestine was removed and entire colon was excised for length measurement. The Colon was cut in half (proximal and distal) and snap frozen. The ileum proximal to cecum was removed and snap frozen. Fecal matter was carefully removed from all the intestinal tissues collected. Mesenteric LNs were collected and snap frozen. For Histology (2 out of 6 animals from each group) an entire intestine was removed and flushed with PBS followed by 10% NBF. The entire intestine, intact, was fixed overnight in 10% NBF and transferred to 70% ETOH and submitted for histology.

Tissues were obtained from mice after onset of disease in a murine model of T-cell adoptive transfer colitis. The model was performed following standard procedures of adoptive transfer of naive T cells into minor histocompatibility mismatched or syngeneic immunocompromised mice and included appropriate immunocompromised, non-diseased controls. Tissues that were collected included the distal part of small intestine, proximal colon, distal colon and mesenteric lymph node. RNA was isolated from all tissues using standard procedures. In brief, tissues were collected and immediately frozen in liquid N2 and then transferred to −800 C until processing. For processing, tissues were placed in Qiazol reagent (Qiagen, Valencia, Calif.) and RNA was isolated using the Qiagen Rneasy kit according to manufacturer's recommendations. Expression was measured with multiplex real-time quantitative RT-PCR method (TaqMan) and the ABI PRISM 7900 sequence detection system (PE Applied Biosystems). IL-17mRNA levels were normalized to the expression of the murine hypoxanthine guanine physphoribosyl transferase mRNA and determined by the comparative threshold cycle method (User Bulletin 2; PE Applied Biosystems). The primers and probe for murine IL-17A and IL-23p19 were the same as described in Example 11.

Results:

IL-17A mRNA:
In the distal colon, mice with colitis had levels of IL-17A mRNA that were approximately 9000-fold greater than levels from control mice (no colitis).
In the proximal colon, mice with colitis had levels of IL-17A mRNA that were approximately 18,900-fold greater than levels from control mice (no colitis).
In the small intestine, mice with colitis had levels of IL-17A mRNA that were approximately 990-fold greater than levels from control mice (no colitis).
In the mesenteric lymph nodes, mice with colitis had levels of IL-17A mRNA that were approximately 175-fold greater than levels from control mice (no colitis).
In all these samples, IL-17A mRNA was basically undetectable in control mice.

IL-17F mRNA
In the distal colon, mice with colitis had levels of IL-17F mRNA that were approximately 3.8-fold greater than levels from control mice (no colitis).
In the proximal colon, mice with colitis had levels of IL-17F mRNA that were approximately 7.4-fold greater than levels from control mice (no colitis).
In the small intestine, mice with colitis had levels of IL-17F mRNA that were approximately 4.8-fold greater than levels from control mice (no colitis).
In the mesenteric lymph nodes, mice with colitis had levels of IL-17F mRNA that were approximately 213-fold greater than levels from control mice (no colitis).

IL-23p19 mRNA
In the small intestine, mice with colitis had levels of IL-23p19 mRNA that were approximately 2-fold greater than levels from control mice (no colitis).
In the mesenteric lymph nodes, mice with colitis had levels of IL-17A mRNA that were approximately 1.5-fold greater than levels from control mice (no colitis).

Example 20

Effects of IL-17A and IL-23 on Lamina PropPria T cells and Monocytes/Macrophages from Normal and Human IBD Samples Dysregulated or sustained immune-mediated inflammation may contribute to the symptoms and pathology associated with IBD by way of tissue damage or permanent skewing to inappropriate or prolonged immune responses. This model can determine the potential down-stream consequences of exposure of disease-associated T cells and monocytes to IL-17A and IL-23 which may be present in the immediate environmental cytokine mileu of the intestinal tissue.

Therapeutics that would be efficacious in human IBD in vivo, would work in ex vivo models by inhibiting and/or neutralizing the production and/or presence of inflammatory mediators (including but not limited to IL-1b, IL-4, IL-5, IL-6, IL-8, IL-12, IL-13, IL-15, IL-17 A and F, IL-18, IL-23, TNF-a, IFN-g, MIP family members, MCP-1, G- and GM-CSF, etc.).

In this model, T cells and monocytes/macrophages are isolated from intestinal biopsy samples by carefully mincing biopsies with scissors in HBSS, treating with collagense and Dispase II and incubating for 1 hr at 37° C. in a shaker. The cell suspension is filtered through nylon mesh to remove debris and cell clumps and washed multiple times in HBSS. T cells and macrophage/monocytes can be isolated using direct cell sorting or bead-depletion/enrichment protocols. Isolated cells are incubated in the presence of IL-17A and IL-23. This induces the production of inflammatory mediators by T cells and monocytes/macrophages or results in skewing subsequent T cell responses to highly pro-inflammatory responses. Comparisons between the types of inflammatory mediators produced by cells from IBD patients and those from cells of normal individuals can be made and might suggest that T cells and monocyte/macrophages from IBD patients produce a more pro-inflammatory profile in the presence of IL-17A and IL-23. The addition of antibodies to IL-17A and IL-23p19 to neutralize the production of downstream inflammatory mediators may be efficacious in the therapeutic treatment of patients with IBD.

Example 21

Efficacy of Antibodies that to Both IL-17A and IL-23 in Irritable Bowel Syndrome ("IBS"): CNS-Directed Pathogenesis A model focusing on primary CNS-directed pathogenesis of IBS which employs stress stimuli to induce symptoms characteristic of IBS. The neonatal psychosocial stress model mimics some clinical features associated with IBS patients including visceral hyperalgesia, diarrhea and stress-sensitivity. Daily separation of the litter from their mothers for 180 minutes each day during postnatal days 4-18 will result in an alteration of maternal behaviour and significantly reduce times of the licking/grooming behaviour. The stress on the neonates results in permanent changes in the CNS resulting in altered stress-induced visceral and somatic pain sensitivity. Colonic motor function in response to stress is enhanced in these animals and preliminary data shows evidence of increased intestinal permeability (Mayer et al., Eur. J. surg. Suppl. (587): 3-9 (2002)). Treatment with the antibodies of the present invention and subsequent analysis of colonic motor function, epithelial permeability and response to stress stimuli could determine efficacy in this animal model of IBS. Decreases in the incidence of symptoms following treatment with these inhibitors would suggest potential efficacy in the treatment of IBS.

Example 22

Efficacy of Antibodies that Antagonize IL-17A and IL-23p19 in Irritable Bowel Syndrome ("IBS"): Primary Gut-Directed Inducers of Stress This is a model focusing on primary gut-directed inducers of stress (ie. gut inflammation, infection or physical stress). Animal studies have indicated that low-grade inflammation or immune activation may be a basis for altered motility, and/or afferent and epithelial function of the gut (Mayer et al., Eur. J. surg. Suppl. (587): 3-9 (2002)). In this model, daily colon irritation is produced in neonatal animals (days 8-21) in the form of daily intracolonic injection of mustard oil. Mustard oil is a neural stimulant and has been shown to induce visceral hyperalgesia following intracolonic administration. This model mimics key features of the IBS including visceral hypersensitivity and alteration in bowel habits. Animals also present with diarrhea or constipation, a key feature of IBS patients (Mayer et al., Eur. J. surg. Suppl. (587): 3-9 (2002)); (Kimball et al., *Am. J. Physiol Gastrointest. Liver Pathol.* 288: G1266 (2005)). An antibody of the present invention could be delivered to determine changes in the development of symptoms associated with this model. Decreases in the incidence or magnitude of visceral hypersensitivity and altered gut motility following therapeutic treatment with our inhibitors would suggest a potential for these molecules to be efficacious in the treatment of IBS.

Example 23

IL-17 NIH-3T3/huIL-17RCx4 Iκβ-α Bioassay

The NIH-3T3/KZ142.8/huIL-17RCx4 transfected cell line was generated as described in WO 2005/123778, filed Jun. 10, 2005. On day one NIH-3T3/KZ142.8/huIL-17RCx4 cells were plated out at 7,500 cells/well in growth media (DMEM with L-Glutamine plus 5% fetal bovine serum, 1% Sodium Pyruvate, 1 µM MTX) in 96-well, flat-bottom tissue culture plates. On day two cells were switched to assay media (DMEM with L-Glutamine plus 0.1% BSA and 10 mM HEPES). On day three serial dilutions of human IL-17A (ZGI *E. coli* material and ZGI 293F B material) were made up in assay media and added to the plates containing the cells and incubated together at 37° C. for 10 minutes. Additionally the assay was also used to measure neutralization of IL-17A activity. A sub-maximal concentration (either $EC_{50}$ or $EC_{90}$, effective concentration at 50 and 90 percent, respectively) of IL-17A was combined with serial dilutions of the human IL-17RA-Fc soluble receptor (ZGI), anti-human IL-17A monoclonal antibody (R&D, MAB317), and anti-human IL-17A polyclonal antibody (R&D, AF317NA) and incubated together at 37° C. for 30 minutes in assay media prior to addition to cells. Following pre-incubation, treatments were added to the plates containing the cells and incubated together at 37° C. for 10 minutes.

Following incubation, cells were washed with ice-cold wash buffer and put on ice to stop the reaction according to manufacturer's instructions (BIO-PLEX Cell Lysis Kit, BIO-RAD Laboratories, Hercules, Calif.). 50 µL/well lysis buffer was added to each well; lysates were pipetted up and down five times while on ice, then agitated on a microplate platform shaker for 20 minutes at 300 rpm and 4° C. Plates were centrifuged at 4500 rpm at 4° C. for 20 minutes. Supernatants were collected and transferred to a new micro titer plate for storage at −20° C.

Capture beads (BIO-PLEX Phospho-Iκβ-α Assay, BIO-RAD Laboratories) were combined with 50 µL of 1:1 diluted lysates and added to a 96-well filter plate according to manufacture's instructions (BIO-PLEX Phosphoprotein Detection Kit, BIO-RAD Laboratories). The aluminum foil-covered plate was incubated overnight at room temperature, with shaking at 300 rpm. The plate was transferred to a microtiter vacuum apparatus and washed three times with wash buffer. After addition of 25 µL/well detection antibody, the foil-covered plate was incubated at room temperature for 30 minutes with shaking at 300 rpm. The plate was filtered and washed three times with wash buffer. Streptavidin-PE (50 µL/well) was added, and the foil-covered plate was incubated at room temperature for 15 minutes with shaking at 300 rpm. The plate was filtered and washed two times with bead resuspension buffer. After the final wash, beads were resuspended in 125 µL/well of bead suspension buffer, shaken for 30 seconds, and read on an array reader (BIO-PLEX, BIO-RAD Laboratories) according to the manufacture's instructions. Data were analyzed using analytical software (BIO-PLEX MANAGER 3.0, BIO-RAD Laboratories). Increases in the level of the phosphorylated Iκβ-α transcription factor present in the lysates were indicative of an IL-17A receptor-ligand interaction. For the neutralization assay, decreases in the level of the phosphorylated Iκβ-α transcription factor present in the lysates were indicative of neutralization of the IL-17A receptor-ligand interaction. $IC_{50}$ (inhibitory concentration at 50 percent) values were calculated using GraphPad Prism®4 software (GraphPad Software, Inc., San Diego Calif.) and expressed as molar ratios for each reagent in the neutralization assay.

IL-17A induced Iκβ-α phosphorylation in a dose dependent manner with an $EC_{90}$ concentration determined to be 0.25 nM for both forms of the ligand. IL-17A was neutralized by the anti-human IL-117A polyclonal antibody at a 1:1 molar ratio, by the human IL-17RA-Fc soluble receptor at a 7:1 molar ratio, and by the anti-human IL-17A monoclonal antibody at a 50:1 molar ratio. TABLE 8 below shows IC50 values of representative IL-17A neutralizing entities described herein, as compared to the IL-17RA-Fc and IL-17A polyclonal antibody controls. Results demonstrate that the IL-17A clones were effective at reducing the signals induced by human IL-17A.

TABLE 8

| | | IC50 (nM) |
|---|---|---|
| | IL17A poly Ab | 1.1 |
| | IL-17RA-Fc | 2.7 |
| cluster id | IL-17A Fab Clone | |
| c87 (SQ7) | M7.19 E7 | 5 |
| c86 (SQ7) | M7.19 D10 | 10 |
| c97 (SQ7) | M7.20 G6 | 21 |
| c95 (SQ7) | M7.20 E5 | 79 |
| c100 (SQ7) | M7.24 G6 | 16 |
| c99 (SQ7) | M7.24 E8 | 56.0 |
| c83 (SQ7) | M7.19 F4 | 27 |
| c98 (SQ7) | M7.24 E5 | >133 |
| c88 (SQ7) | M7.20 F4 | 100 |
| | IL-17A scFv | |

Example 24

IL-23 Baf3/huIL-23R/huIL-12Rβ1 STAT3 Bioassay

The Baf3/KZ134/huIL-23R/huIL-12RB1 Clone 6 transfected cell line was generated as described herein. Baf3/KZ134/huIL-23R/huIL-12RB1 Clone 6 cells were washed two times with assay media (RPMI 1640 with L-Glutamine plus 10% fetal bovine serum, 1% Sodium Pyruvate, and 2 uM β-Mercaptoethanol) before being plated out at 30,000 cells/well in 96-well, round-bottom tissue culture plates. Serial dilutions of recombinant human IL-23 (ZGI CHO material or eBioscience's Insect heterodimer material) were made up in assay media and added to the plates containing the cells and incubated together at 37° C. for 15 minutes. Additionally the assay was also used to measure neutralization of IL-23 activity. A half maximal concentration ($EC_{50}$, effective concentration at 50 percent) of IL-23 was combined with serial dilutions of anti-human IL-12 p40 monoclonal antibody (Pharmingen), anti-human IL-23p19 polyclonal antibody (R&D, AF1716), and human IL-23R-Fc Soluble Receptor (ZGI) and incubated together at 37° C. for 30 minutes in assay media prior to addition to cells. Following pre-incubation, treatments were added to the plates containing the cells and incubated together at 37° C. for 15 minutes.

Following incubation, cells were washed with ice-cold wash buffer and put on ice to stop the reaction according to manufacturer's instructions (BIO-PLEX Cell Lysis Kit, BIO-RAD Laboratories, Hercules, Calif.). Cells were then spun down at 2000 rpm at 4° C. for 5 minutes prior to dumping the media. 50 μL/well lysis buffer was added to each well; lysates were pipetted up and down five times while on ice, then agitated on a microplate platform shaker for 20 minutes at 300 rpm and 4° C. Plates were centrifuged at 4500 rpm at 4° C. for 20 minutes. Supernatants were collected and transferred to a new micro titer plate for storage at −20° C.

Capture beads (BIO-PLEX Phospho-STAT3 Assay, BIO-RAD Laboratories) were combined with 50 μL of 1:1 diluted lysates and added to a 96-well filter plate according to manufacture's instructions (BIO-PLEX Phosphoprotein Detection Kit, BIO-RAD Laboratories). The aluminum foil-covered plate was incubated overnight at room temperature, with shaking at 300 rpm. The plate was transferred to a microtiter vacuum apparatus and washed three times with wash buffer. After addition of 25 μL/well detection antibody, the foil-covered plate was incubated at room temperature for 30 minutes with shaking at 300 rpm. The plate was filtered and washed three times with wash buffer. Streptavidin-PE (50 μL/well) was added, and the foil-covered plate was incubated at room temperature for 15 minutes with shaking at 300 rpm. The plate was filtered and washed two times with bead resuspension buffer. After the final wash, beads were resuspended in 125 μL/well of bead suspension buffer, shaken for 30 seconds, and read on an array reader (BIO-PLEX, BIO-RAD Laboratories) according to the manufacture's instructions. Data were analyzed using analytical software (BIO-PLEX MANAGER 3.0, BIO-RAD Laboratories). Increases in the level of the phosphorylated STAT3 transcription factor present in the lysates were indicative of an IL-23 receptor-ligand interaction. For the neutralization assay, decreases in the level of the phosphorylated STAT3 transcription factor present in the lysates were indicative of neutralization of the IL-23 receptor-ligand interaction. $IC_{50}$ (inhibitory concentration at 50 percent) values were calculated using GraphPad Prism®4 software (GraphPad Software, Inc., San Diego Calif.) and expressed as molar ratios for each reagent in the neutralization assay.

IL-23 induced STAT3 phosphorylation in a dose dependent manner with an $EC_{50}$ concentration determined to be 20 pM for ZGI A1806F and 30 pM for eBioscience heterodimer. Table 9 presents example IC50 data for the IL-23 positive controls (IL-23p19 polyAb and IL-23R-Fc) and IL-23 neutralizing entities described herein. These data indicate that the IL-23 neutralizing entities were efficacious and were equally or better at reducing the effects of IL-23 as the controls.

TABLE 9

| | | IC50 (nM) |
|---|---|---|
| IL-23 p19 polyAb | | 65-126 |
| IL-23R-Fc | | 11-14 |
| cluster i.d. | IL-23 Fab Clone | |
| c41 (SQ7) | M7.12 B9 | 1.4 |
| c29 (SQ7) | M7.12 F9 | 2.3 |
| c36 (SQ7) | M7.9 G9 | 2.3 |
| c29 (SQ7) | M7.13 D7 | 7.4 |
| c101 (SQ7) | M7.3 D4 | 81 |
| c27 (SQ7) | M7.9 A7 | 34.0 |
| c87 (SQ7) | M7.7 F5 | >133 |
| c103 (SQ7) | M7.12 A7 | >133 |
| IL-23 scFv | | |
| c305 (SQ22) | M7.36.B6 | Range of 0.13-3.8 |
| c304 (SQ22) | M7.36.D3 | 31 |
| c303 (SQ22) | M7.35.E9 | >133 |
| c302 (SQ22) | M7.35.C9 | >133 |

Example 25

Cynomologus Monkey IL-17A and IL-23p19 Polynucleotide Sequences

CnIL-17A was cloned by PCR using a high fidelity thermostable polymerase. (Expand, Roche Applied Science, Indianapolis, Ind.) Based on available sequence information from the UCSC Genome Browser for chimp and human IL-17A, oligonucleotides 56837 (SEQ ID NO: 27) and 56838 (SEQ ID NO: 28) were designed to amplify the cynomologus gene open reading frame. An oligo dT primer was used to initiate cDNA synthesis from total RNA purified from PMA and Ionomycin stimulated cynomologus monkey PBMC's using SuperscriptII Reverse Transcriptase following the manufacturers recommendations (Invitrogen corp. Carlsbad, Calif.). PBMC's were isolated from whole blood obtained from a 13 year old male M. fascularis animal and stimulated for 4 hours in 10 ng/ml PMA and 0.5 ug/ml Ionomycin. Total RNA isolated using RNeasy mini kit (Qiagen, Inc. Valencia, Calif.) following the manufacturers recommendations. Due to the lack of sequence information for the cynomologus monkey, a number PCR products were cloned into PCR4 TO (Invitrogen corp. Carlsbad, Calif.) for sequence comparisons. A nucleotide consensus sequence was obtained from 12 clones and is shown in SEQ ID NO: 29.

CnIL-23p19 was cloned by PCR using a high fidelity thermostable polymerase. (Expand, Roche Applied Science, Indianapolis, Ind.) Based on available sequence information from the UCSC Genome Browser for chimp and human IL-23p19, oligonucleotides 56846 (SEQ ID NO: 1016) and 56855 (SEQ ID NO: 1017) were designed to amplify the cynomologus gene. An oligo dT primer was used to initiate cDNA synthesis from total RNA purified from LPS, ploy IC, TNF and CD40 μg. stimulated monocyte derived dendridic cell's using SuperscriptII Reverse Transcriptase following the manufacturers recommendations (Invitrogen corp. Carlsbad, Calif.). PBMC's were isolated from whole blood obtained from a X year old male M. fascularis animal and used to purify CD 14+ cells using CD14 non-human primate microbeads (Miltneyi Biotec, Bergisch Gremany). CD 14+ cells were differentiated for 4 days with 10 ng/ml each hGMCSF and hIL-4 then stimulated for 4 hours with 1 ug/ml LPS, 25 ug/ml polyIC, 20 ng/ml TNF and 10 ug/ml CD40 μg. Total RNA was isolated using RNeasy mini kit (Qiagen, Inc. Valencia, Calif.) following the manufacturers recommendations. Due to the lack of sequence information for the cynomologus monkey, a number PCR products were cloned into PCR4 TO (Invitrogen corp. Carlsbad, Calif.) for sequence comparisons. A nucleotide consensus sequence was obtained from 16 clones and is shown in SEQ ID NO: 30.

Example 26

IL-12 Bioassay

Leukopheresis PBMC: To obtain a consistent pool of PBMC's, normal human donors were voluntarily apheresed. The leukopheresis PBMC were poured into a sterile 500 ml plastic bottle, diluted to 400 ml with room temperature PBS+1 mM EDTA and transferred to 250 ml conical tubes. The 250 ml tubes were centrifuged at 1500 rpm for 10 minutes to pellet the cells. The cell supernatant was then removed and discarded. The cell pellets were then combined and suspended in 400 ml PBS+1 mM EDTA. The cell suspension (25 ml/tube) was overlaid onto Ficoll (20 ml/tube) in 50 ml conical tubes (total of 16 tubes). The tubes were centrifuged at 2000 rpm for 20 minutes at room temperature. The interface layer ("buffy coat") containing the white blood cells and residual platelets was collected, pooled and washed repeatedly with PBS+1 mM EDTA until the majority of the platelets had been removed. The white blood cells were then suspended in 100 ml of ice-cold Cryopreservation medium (70% RPMI+20% FCS+10% DMSO) and distributed into sterile cryovials (1 ml cells/vial). The cryovials were placed in a $-80°$ C. freezer for 24 hours before transfer to a liquid-nitrogen freezer. The white blood-cell yield from a typical apheresis is $0.5$–$1.0 \times 10^{10}$ cells. Apheresis cells processed in this manner contain T cells, B cells, NK cells, monocytes and dendritic cells.

Preparation of PHA blasts: T cells must be activated in order to express the IL-12 receptor and be able to respond to IL-12 and IL-23. Cryopreserved leukopheresis PBMC were thawed, transferred to a sterile 50 ml conical tube, washed once with 50 ml of warm RPMI+10% heat-inactivated FBS+1 ug/ml DNAse I (Calbiochem), resuspended in 50 ml of fresh RPMI/FBS/DNAse medium and incubated in a 37° F. water bath for at least 1 hour to allow the cells to recover from being thawed. The cells were then centrifuged and the cell-supernatant discarded. The cell pellet was resuspended in RPMI+10% FBS and distributed into sterile 75 cm$^2$ tissue culture flasks ($1 \times 10^7$ cells/flask in 40 ml/flask). PHA-L (5 mg/ml stock in PBS) was added to the cells at a final concentration of 5 ug/ml. The cells were then cultured at 37° C. in a humidified incubator for a total of 5 days. The cells were "rested" for some experiments by harvesting the cells on the afternoon of day 4, replacing the culture medium with fresh RPMI+10% FBS without PHA-L (40 ml/flask) and returning the cells to their flasks and incubating at 37° C. the cells in a humidified incubator for the remainder of the 5 day culture period.

IL-12 and Il-23 bioassays: Three in vitro assays for detection of human IL-12 and Il-23 bioactivity on normal human T cells have been established: 1) IFN-gamma and MIP-1alpha production, 2) proliferation ([$^3$H]-incorporation) and 3) STAT3 activation. Human PHA blasts (activated T cells) were harvested on day 5 of culture, suspended in fresh RPMI+10% FBS and plated at the desired cell number per well in 96 well plates.

The inclusion of an IL-12 assay was used to determine specificity of the neutralizing entities described herein for IL-23p19 and not IL-12.

For the IFN-gamma production assay, the cells were plated at $1 \times 10^6$/well in flat-bottom 96-well plates. The cells were cultured at 37° C. in a final volume of 200 ul/well with either medium alone, human IL-2 alone (10 ng/ml; R & D Systems), human IL-12 alone (graded doses; Invitrogen), human IL-23 alone (graded doses; ZGI lot #A1806; CHO-derived), anti-human CD28 mAb alone (graded doses; clone 28.2, e-Biosciences), or each cytokine in combination with anti-human CD28 mAb. Triplicate wells were set up for each culture condition. For the IFN-gamma production assay, cell supernatants (120 ul/well) were harvested after 24-48 hours of culturing the cells at 37° C. in a humidified incubator. Human IFN-gamma and MIP-1alpha concentrations in these supernatants (pooled for each triplicate) were measured using a commercial Luminex bead-based ELISA kit (Invitrogen) following the manufacturer's instructions.

Effects of IL-23 on IFN-gamma and MIP-1alpha production were enhanced by culturing the cells with plate-immobilized anti-human CD3 mAb (5 ug/ml) and soluble anti-human CD28 mAb (1 ug/ml) as well as harvesting the supernatants (120 ul/well) after 48 hrs of culture at 37° C. the cells in a humidified incubator. Human IFN-gamma concentrations in these supernatants (pooled for each triplicate) were measured using a commercial Luminex bead-based ELISA kit (Invitrogen) following the manufacturer's instructions.

For the [$^3$H]-incorporation assay the cells were plated at $2 \times 10^5$ cells/well in U-bottom 96-well plates. The cells were cultured at 37 degrees C. for 72 hours. The cells were pulsed with 1 uCi/well of [$^3$H]-Thymidine (Amersham) for the last 8 hours of this culture period. The cells were then harvested onto glass-fiber filters and the CPMs of [$^3$H] incorporated were quantitated using a beta counter (Topcount NXT, Packard).

For each of these above endpoint parameters, effective neutralization of activity mediated by IL-23 was observed in the presence of anti-IL23p19 neutralizing entities described herein at IC50 values that ranged from 0.1 to ~100 nM. There was no effect of the anti-IL-23p19 antagonists on neutralizing the effects mediated by IL-12, indicating specificity of the antagonists to IL-23p19.

STAT3 Bioassay: For the STAT3 Bioassay the cells were plated at $2 \times 10^5$ cells/well in U-bottom 96-well plates. Serial dilutions of human IL-12 (R&D) or recombinant human IL-23 (ZGI CHO-derived material or eBioscience's Insect heterodimer material) were prepared in assay media (RPMI 1640 with L-Glutamine plus 10% fetal bovine serum), added to the plates containing the cells and incubated together at 37° C. for 15 minutes. Additionally, the assay was also used to measure neutralization of IL-12 and IL-23 activity using either commercially-available neutralizing reagents (as "controls") or the anti-IL-23p19-containing neutralizing entities described herein. A half-maximal concentration (EC$_{50}$, effective concentration at 50 percent) of IL-12 or IL-23 were combined with serial dilutions of anti-human IL-12 p40 monoclonal antibody (Pharmingen), anti-human IL-23 p19 polyclonal antibody (R&D, AF 1716), human IL-23R-Fc Soluble Receptor (ZGI), or any of the neutralizing entities described herein, and incubated together at 37° C. for 30 minutes in assay media prior to addition to cells. Following pre-incubation, treatments were added to the plates containing the cells and incubated together at 37° C. for 15 minutes.

Following incubation, cells were washed with ice-cold wash buffer and put on ice to stop the reaction, according to manufacturer's instructions (BIO-PLEX Cell Lysis Kit, BIO-RAD Laboratories, Hercules, Calif.). Cells were then spun down at 2000 rpm at 4° C. for 5 minutes prior to removing the media. 50 ul/well lysis buffer was added to each well; lysates were pipetted up and down five times while on ice, then agitated on a microplate platform shaker for 20 minutes at 300 rpm and 4° C. Plates were centrifuged at 4500 rpm at 4° C. for 20 minutes. Supernatants were collected and transferred to a new micro titer plate for storage at −20° C.

Capture beads (BIO-PLEX Phospho-STAT3 Assay, BIO-RAD Laboratories) were combined with 50 ul of 1:1 diluted lysates and added to a 96-well filter plate according to manufacture's instructions (BIO-PLEX Phosphoprotein Detection Kit, BIO-RAD Laboratories). The aluminum foil-covered plate was incubated overnight at room temperature, with shaking at 300 rpm. The plate was transferred to a microtiter vacuum apparatus and washed three times with wash buffer. After addition of 25 µL/well detection antibody, the foil-covered plate was incubated at room temperature for 30 minutes with shaking at 300 rpm. The plate was filtered and washed three times with wash buffer. Streptavidin-PE (50 ul/well) was added, and the foil-covered plate was incubated at room temperature for 15 minutes with shaking at 300 rpm. The plate was filtered and washed two times with bead resuspension buffer. After the final wash, beads were resuspended in 125 ul/well of bead suspension buffer, shaken for 30 seconds, and read on an array reader (BIO-PLEX, BIO-RAD Laboratories) according to the manufacture's instructions. Data were analyzed using analytical software (BIO-PLEX MANAGER 3.0, BIO-RAD Laboratories).

Increases in the level of the phosphorylated STAT3 transcription factor present in the lysates were indicative of an IL-12 or IL-23 receptor-ligand interaction. For the neutralization assay, decreases in the level of the phosphorylated STAT3 transcription factor present in the lysates were indicative of neutralization of the IL-12 or IL-23 receptor-ligand interaction. $IC_{50}$ (inhibitory concentration at 50 percent) values were calculated using GraphPad Prism®4 software (GraphPad Software, Inc., San Diego Calif.) and expressed as molar ratios for each reagent and/or neutralizing entity in the neutralization assay.

IL-12 and IL-23 both induced STAT3 phosphorylation in a dose dependent manner with variation from donor to donor in PHA-activated human T cells. EC50 values for IL-23 were in the range of 12-53 pM. IL-12 and IL-23 were both neutralized by the anti-human IL-12 p40 monoclonal antibody, whereas only IL-23 was neutralized by the anti-human IL-23 p19 polyclonal antibody and human IL-23R-Fc controls, and by the anti-IL23p19 neutralizing entities described herein For just one example, for one donor an EC50 concentration was determined to be 200 pM for IL-12 and 20 pM for IL-23 (using ZGI CHO-derived protein lot A1806F) and 30 pM for IL-23 (using the ebioscience heterodimer). IL-12 and IL-23 were both neutralized by the commercially available anti-human IL-12 p40 monoclonal antibody. Only IL-23 was neutralized by the commercially available anti-human IL-23 p19 polyclonal antibody and human IL-23R-Fc soluble receptor (as "controls"), indicating that this assay is specific for its intended cytokine activity/neutralization use. Results indicated that the efficacious neutralizing entities described herein were equally or better than the commercially available reagents at neutralizing the effects of rhIL-23. (see Table 10 for representative example neutralizing values). Furthermore, results indicate that the neutralizing entities specifically inhibited rhIL-23 and not IL-12 (data not shown; all data graphs indicated absolutely no neutralizing ability of anti-IL-23p19 clones against IL-12 induced activity).

TABLE 10

IC50 Values for Neutralization of IL-23-Mediated pSTAT3 Activity in Human PHA Blasts

|  |  | IC50 (nM) |
| --- | --- | --- |
|  | IL23 p19 pAb | 52 |
|  | IL-23R-Fc | 3 |
| cluster i.d. | IL-23 Fab Clone | IMAC |
| c41 (SQ7) | M7.12 B9 | 1.8 |
| c29 (SQ7) | M7.12 F9 | 5.3 |

TABLE 10-continued

IC50 Values for Neutralization of IL-23-Mediated pSTAT3 Activity in Human PHA Blasts

|  |  | IC50 (nM) |
| --- | --- | --- |
| c36 (SQ7) | M7.9 G9 | 2.7 |
| c29 (SQ7) | M7.13 D7 | 7.9 |
| c101 (SQ7) | M7.3 D4 | 53 |
| c27 (SQ7) | M7.9 A7 | 85.0 |
| c87 (SQ7) | M7.7 F5 | 90-100 |
| c103 (SQ7) | M7.12 A7 | 90-100 |
| c103 (SQ7) | M7.13 A6 | 90-100 |

Example 27

Bioassay for Neutralization of huIL-17-Induced Cytokine Production in Human Small Airway Epithelial Cells (SAEC IL-12 PHA Bioassay)

Treatment of human small airway epithelial cells (SAEC) with rhIL-17 induces the production of cytokines G-CSF, IL-6, and IL-8, which in turn, play a role in the pathology associated with the diseases for which an IL17/IL23p19 neutralizing entity would be efficacious. The ability of any of the neutralizing entities described herein to inhibit rhIL-17-mediated production of these cytokines is measured in this bioassay, thus being predictive of in vivo efficacy against these cytokines as well.

Method: SAEC (cells and growth media purchased from Cambrex, Inc.) were plated at 8,000 cells/well in 96-well flat bottom tissue culture multi-well plates, and placed in a 37° C., 5% $CO_2$ incubator. The following day, cells were treated with a dose range of the neutralizing entity in combination with 10-20 ng/mL rhIL-17. The ligand and neutralizing entity were incubated together for 30 minutes at 37° C. before adding to the cells. Duplicate or triplicate wells were set up for each dose. After 24-48 hours, supernatants are collected, and stored at −80° C. if not used directly. Before taking supernatants, wells were scanned by inverted microscope to make note of which wells had considerable cell death. Those wells were not included in the final calculations. Supernatants were then assayed for cytokines huG-CSF, huIL-6, and huIL-8 in a multiplex bead-based assay system (Bio-Rad Laboratories), and IC50 determined.

Results: In the presence of rhIL-17, the neutralizing entitities described herein were efficacious at reducing cytokine production with IC50 values ranging from 0.1-100 nM. Though there was some inter-experiment variable due to different donors of SAEC, there were clearly some anti-IL 17A clones that had better neutralizing capacities than others. For example, with one donor SAEC, clone M7.19.E7 (SQ7_c87) had an IC50 of 31.1 nM to inhibit human IL-17A induced G-CSF production, whereas with another donor SAEC cultures, the same clone was able to inhibit IL-17A-mediated G-CSF production with an IC50 of 13.4 nM. These data demonstrate that although there was inter-donor/-experiment variability, the IL-17A neutralizing entities were effective at neutralizing the biological effects of IL-17A on human primary cells.

Example 28

Combination of Anti-IL-17 and Anti-IL-23p19 mAb in Murine Colitis is More Efficacious Than Either mAb Alone IL-23 and IL-17 are important players in murine colitis and human IBD, via the actions of Th17 cells. IL-23 and IL-17 are upregulated in colitis and IBD, and neutralization of either cytokine alone is efficacious in several animal models of colitis (Fujino et al, *Gut*, 2003, 52:65-70; Schmidt et al, *Inflamm Bowel Dis*. 2005, 11:16-23; Yen et al, *J Clin Invest*. 2006, 116:1310-1316; Zhang et al, *Inflamm Bowel Dis*. 2006, 12:382-388; Kullberg et al, *J Exp Med*. 2006, 203:2485-94.). Since IL-23 is important for the maintenance, differentiation, and/or induction of Th17 cells, neutralization of both cytokines would be more efficacious at reducing disease than either cytokine alone. The current example provides data to support this in oxazalone-induced colitis model, which resembles human ulcerative colitis (UC).

Methods: For this experiment, 40 C57BL/10 female mice (obtained from Harlan) were used. On day −5, mice were treated topically with 200 ul of 3.0% (w/v) oxazalone in 100% ethanol ("sensitization") on the abdomen. On day 0, all mice receive intrarectal injections (120 uL each) of 2.0% (w/v) oxazalone in 50% ethanol while under light isoflurane gas anesthesia ("challenge"). Mice were monitored for disease using a Disease Activity Index (DAI) score, which includes stool consistency, body weight, and blood in stool. For mAb treatments, mice were administered one of the following, via i.p. injection on days −5, −3, and −1: PBS, 50 ug neutralizing anti-mouse IL-17, 50 ug neutralizing anti-mouse IL-23p19 mAb, or a combination of the anti-IL17+IL-23p19 mAb's.

Mice were euthanized on day 2. Serum was collected and stored for later analysis; colons were removed and observed for any gross signs of colitis (lesion, colon shortening, and colon wall thickening). Colons were then cut longitudinally and processed for histology and for 24 h colon cultures.

Results: There was a significant reduction (p=0.0216; 54% reduction compared to PBS group) in DAI score and significant (p<0.05) improvement in histological morphology (e.g. reduced colonic damage and reduced inflammation) in mice treated with the combination of anti-IL-17+anti-IL-23p19 anitbodies, compared to PBS and either mAb alone. Consistent with these benefits, mice treated with the combination of antibodies also had significant improvements (p<0.0112) in colon shortening compared to PBS-treated mice and mice treated with either of the antibodies alone. In the production of inflammatory cyokines from colon cultures, oxazolone mice treated with the anti-IL-17+IL-23p19 combination antibodies had less increases in IL-1b, IL-12, IL-13, IL-17, IL-23, and TNF-a compared to PBS-treated oxazalone mice. Treatment with the combination of anti-IL-17+IL-23p19 antibodies also resulted in significant reductions in serum IL-12, IL-17, IL-23, and TNF-a concentrations compared to PBS-treated mice.

Therefore, the delivery of the therapeutic combination of anti-IL-17 and anti-IL-23p19 antibodies was significantly more efficacious in reducing colitis from several aspects: disease symptoms, pathology, and inflammatory cytokine production. Taken together, these results indicate that the therapeutic combination of IL-17 and IL-23/p19 neutralizing antibodies is more efficacious in the treatment of oxazolone colitis as a model of human IBD. The therapeutic combination can reduce clinical disease symptoms and works at the molecular level to reduce inflammation, tissue damage, inflammatory cytokines, and other mechanisms known to be affected in this manner.

Example 29

Measurement of Binding Affinities of Anti-IL-17A Molecules to IL-17A Via Surface Plasmon Resonance (Biacore)

Anti-IL-17A entities described herein were evaluated for their binding affinities to IL-17A using surface plasmon resonance and Biacore T-100 instrument (GE Healthcare). Recombinant human IL-17A was immobilized to the sensor chip, followed by passing the antagonists over the immobilized ligand to attain affinity measurements. These methods allow for binding affinity measurements of the IL-17A neutralizing entities for their respective ligand (IL-17A) and also demonstrate specificity for IL-17A by displaying no binding to similar but different ligands, such as other members of the IL-17 family.

To determine the best conditions for immobilization, a series of pH scouting experiments were performed. For these experiments, recombinant human IL-17A (ZGI lot A1781F) was diluted to 100 nM in five different immobilization buffers; Acetate-4.0, Acetate-4.5, Acetate-5.0, Acetate-5.5, and Borate-8.5. Using Immobilization Scouting Wizard, these conditions were tested and at the end Acetate-4.0 was the best condition for immobilization.

For the immobilization procedure, IL-17A protein was diluted to 10 ug/ml in Acetate-4.5, and then immobilized onto a Series S Sensor Chip (CM5, GE Healthcare/Biacore #BR-1006-68) using the amine coupling kit and Biacore Immobilization Wizard. Briefly, the level of immobilization was targeted to 300 Biacore Resonance Units (RU), and IL-17A was only injected over an active flow cell. After the immobilization procedure, active sites on the flow cell were blocked with ethanolamine. Non-specifically bound protein was removed by washing with 50 mM NaOH. The final immobilization level was 466 RU. The reference cell was activated and then blocked with ethanolamine.

For the kinetic run, serial dilutions of the control proteins, IL-17RA-Fc (ZGI lot A1763F) or IL-17A monoclonal antibody (R&D MAB317), or anti-IL-17A neutralizing entities described herein, were prepared in 1×HBS-EP+buffer. Duplicate injections of each concentration were performed. The analyte injections were at 30 ul/min with a dissociation time of 600 seconds. Buffer injections were also performed to allow for subtraction of instrument noise and drift.

Regeneration buffers supplied in the Regeneration Scouting Kit (GE Healthcare/Biacore # BR-1005-56) were used to determine regeneration conditions. Standard Biacore methods were performed to define the best regeneration conditions for an IL-17A surface using IL-17RA-Fc at 100 nM. Mildest conditions were tested first and moved up in strength. The final regeneration condition chosen was a 1-60 sec pulse of 10 mM H3PO4 followed by a 1-60 sec pulse of 1×HSB-EP buffer at 50 ul/min.

As a check for IL-17A specific interactions, similar procedures were followed using immobilized recombinant human IL-17F (ZGI lot A1275F).

Data were analyzed using Biacore Evaluation software (v. 1.1.1) to define the kinetic values of the interaction of IL-17A with the control proteins (IL-17A monoclonal antibody and IL-17RA-Fc) and IL-17A neutralizing entities described herein. Baseline stability was assessed to ensure that the regeneration step provided a consistent binding surface throughout the sequence of injections. Binding curves were normalized by double-referencing, and duplicate injection curves were checked for reproducibility. The resulting binding curves were globally fit to the bivalent interaction model.

The data demonstrate high affinity binding of human IL-17A to the control antagonist proteins (IL-17RA-Fc and anti-IL-17A monoclonal antibody) and to the IL-17A neutralizing entities described herein. There was no binding of the control IL-17A antagonist proteins or the anti-IL-17A neutralizing entities to IL-17F, thus providing evidence for specificity of targeting IL-17A.

Specifically, human IL-17A demonstrates dissociation equilibrium constants (KD) for IL-17R-Fc to be approximately 5 nM and approximately 2 nM for the IL-17A monoclonal antibody. Neutralizing entities described herein display a large range of affinities, but are well within this range (0.4-<15 nM), thus demonstrating comparable binding affinities.

Example 30

Off-Rate Analysis of Anti-IL-17A Molecules to IL-17A Via Surface Plasmon Resonance (Biacore)

Anti-IL-17A entities described herein were evaluated for binding off-rates to IL-17A using surface plasmon resonance and Biacore T-100 instrument (GE Healthcare). Off-rate analysis is thought to help estimate the interaction that occurs in vivo, since a slow off-rate would predict a greater degree of interaction over long period of time. For these experiments, recombinant human IL-17A was immobilized to the sensor chip, followed by passing the antagonists over the immobilized ligand to attain off-rate analyses. Similar to the Biacore affinity example (see EXAMPLE 29), IL-17F was used as the negative control, in order to demonstrate IL-17A specificity.

To determine the best conditions for immobilization, a series of pH scouting experiments were performed. For these experiments, recombinant human IL-17A (ZGI lot A178 1F) or human IL-17F (ZGI lot A1275F) was diluted to 100 nM in five different immobilization buffers; Acetate-4.0, Acetate-4.5, Acetate-5.0, Acetate-5.5, and Borate-8.5. Using Immobilization Scouting Wizard, these conditions were tested and at the end, Acetate-4.0 was the best condition for immobilization.

For the immobilization procedure, human IL-17A (native and biotinylated) and IL-17F were diluted to 10 ug/ml in Acetate-4.0. All three proteins were immobilized onto a Series S Sensor Chip (CM5, GE Healthcare/Biacore #BR-1006-68) using the amine coupling kit and Biacore Immobilization Wizard. Briefly, the level of immobilization was targeted to 500 Biacore Resonance Units (RU). Flow cell 1 was used as the reference, and therefore was only activated and then blocked with ethanolamine. The native form of IL-17A was immobilized to flow cell 2, biotinylated IL-17A was immobilized to flow cell 3 and IL-17F was immobilized to flow cell 4. Analyte was injected only over active flow cells (flow cells 2, 3 and 4). After the immobilization, the active sites on the flow cell were blocked with ethanolamine. Non-specifically bound protein was removed by washing with 50 mM NaOH. The final immobilization level for flow cell 1 (reference) was 175.0 RU and fell between 669.5 and 695.6 RU for the active flow cells (flow cells 2-4).

Samples of the anti-IL-17A neutralizing entities were diluted to 100 nM in 1×HBS-EP+buffer (GE Healthcare/Biacore, #BR-1006-69). IL-17RA-Fc and IL-17A monoclonal antibody were also prepared at 100 nM in 1×HBS-EP+buffer as positive controls. Duplicate injections of each sample were performed. The analyte injections were at 30 ul/min with a dissociation time of 600 seconds. Buffer injections were also performed to allow for subtraction of instrument noise and drift.

Regeneration buffers supplied in a regeneration scouting kit were used to determine regeneration conditions. Using this procedure, the optimal regeneration condition was found to be 60 seconds of 10 mM H3PO4 followed with 60 seconds of 1×HBS-EP+buffer injections at a flow rate of 50 ul/minute.

Data were evaluated using Biacore Evaluation software to define the off-rate of the interactions of anti-IL-17A neutralizing entities to immobilized IL-17A. Baseline stability was assessed to ensure that the regeneration step provided a consistent binding surface throughout the sequence of injections. Binding curves were normalized by double-referencing. Duplicate injection curves were checked for reproducibility and the resulting binding curves were globally-fit to the bivalent interaction model.

All data for Biacore kinetics experiments were collected and analyzed using Biacore Evaluation Software v1.1.1. Final sensorgrams of the IL-17A neutralizing entities were all y-normalized immediately before dissociation phase. These dissociation curves were used to rank samples according to their off-rates, slowest to fastest. Off-rates were compared to the positive controls, IL-17A-Fc (off-rate of 2.53×10-5 sec-1).

TABLE 11a anti-IL-17A Fabs Off-rat Rankings: Panel #1

| Sample (clone and cluster id) | off-rate (slow to fast) |
|---|---|
| IL17RA | $k_d$ = 2.53E−05 |
| M7.20.G6 (c97) | slow $k_d$ |
| M7.19.E7 (c87) | ↓ |
| M7.19.F4 (c83) | ↓ |
| M7.24.E8 (c99) | ↓ |
| M7.20.E5 (c95) | ↓ |
| M7.19.D10 (c86) | ↓ |
| M7.24.G6 (c100) | fast $k_d$ |

***M7.24.E5 (c98)

TABLE 11b anti-IL-17A Fabs Off-rate Rankings: Panel #2

| Sample | off-rate (slow to fast) |
|---|---|
| IL17RA | $k_d$ = 2.53E−05 |
| M7.19.E7 (c87) | slow $k_d$ |
| M7.24.A5 (c88) | ↓ |
| M7.24.A4 (c94) | ↓ |
| M7.20.F11 (c96) | ↓ |
| M7.20.A9 (c90) | ↓ |
| M7.20.C10 (c94) | fast $k_d$ |
| M7.24.D8 | |

TABLE 11c anti-IL-17A scFv Off-rate Rankings

| RANKING | Clone # |
|---|---|
| 1 | M7.42_C11 |
| 1 | M7.42_C09 |
| 2 | M7.46_A02 |
| 2 | M7.44_F09 |
| 3 | M7.73_B05 |
| 3 | M7.44_F09 |
| 3 | M7.41_A02 |

TABLE 11c-continued anti-IL-17A scFv Off-rate Rankings

| RANKING | Clone # |
|---|---|
| 4 | M7.73_D03 |
| 4 | M7.76_D11 |
| 4 | M7.70_G02 |
| 4 | M7.70_G08 |
| 4 | M7.68_F06 |
| 4 | M7.72_B10 |
| 5 | M7.70_F05 |
| 5 | M7.46_B08 |
| 6 | M7.46_E07 |
| 7 | M7.68_E02 |
| 7 | M7.75_B06 |
| 7 | M7.70_E10 |
| 7 | M7.44_H04 |
| 7 | M7.42_A10 |
| 7 | M7.46_D08 |
| 7 | M7.42_E10 |
| 7 | M7.44_E05 |
| 7 | M7.70_G11 |
| 7 | M7.45_H08 |
| 7 | M7.69_C07 |
| 7 | M7.70_B04 |
| 7 | M7.70_D07 |
| 7 | M7.68_G06 |
| 7 | M7.73_G04 |
| 7 | M7.74_C11 |
| 7 | M7.70_H11 |
| 7 | M7.73_F04 |
| 7 | M7.72_F03 |
| 7 | M7.46_B05 |
| 7 | M7.72_C11 |
| 8 | M7.72_E03 |

Example 31

Measurement of Binding Affinities of Anti-IL-23p19 Molecules to IL-23 Via Surface Plasmon Resonance (Biacore)

Anti-IL-23p19 entities described herein were evaluated for their binding affinities to IL-23 using surface plasmon resonance and Biacore T-100 instrument (GE Healthcare). Recombinant human IL-23 was immobilized to the sensor chip, followed by passing the antagonists over the immobilized ligand to attain affinity measurements. These methods allow for binding affinity measurements of the IL-23p19 neutralizing entities for their respective ligand (IL-23) and also demonstrate specificity for IL-23 by displaying no binding to similar but different ligands, such as IL-12.

To determine the best conditions for immobilization, a series of pH scouting experiments were performed. For these experiments, recombinant human IL-23 (ZGI lot A1806F) was diluted to 100 nM in five different immobilization buffers; Acetate-4.0, Acetate-4.5, Acetate-5.0, Acetate-5.5, and Borate-8.5. Using Immobilization Scouting Wizard, these conditions were tested and at the end Acetate-4.5 was the best condition for immobilization.

For the immobilization procedure, IL-23 protein was diluted to 10 ug/ml in Acetate-4.5, and then immobilized onto a Series S Sensor Chip (CM5, GE Healthcare/Biacore #BR-1006-68) using the amine coupling kit and Biacore Immobilization Wizard. Briefly, the level of immobilization was targeted to 300 Biacore Resonance Units (RU), and IL-23 was only injected over an active flow cell. After the immobilization procedure, active sites on the flow cell were blocked with ethanolamine. Non-specifically bound protein was removed by washing with 50 mM NaOH. The final immobilization level was 466RU. The reference cell was activated and then blocked with ethanolamine.

To determine the optimal contact time, RL (resonance signal of the ligand) testing was performed. Control proteins, soluble IL-23R-Fc (ZGI lot A1913F) and an anti-IL-23p19 polyclonal antibody (R&D Systems), were diluted to 100 nM in 1× HSB-EP+running buffer (GE Healthcare/Biacore, #BR-1006-69). The IL-23R-Fc or IL-23p19 polyclonal antibody were injected over both the active and reference cells for three different contact times. From this RL testing, the contact time for the IL-23p19 polyclonal antibody was determined to be 60 seconds and for IL-23R-Fc, it was 300 seconds.

For the kinetic run, serial dilutions of the control proteins, IL-23R-Fc or IL-23p19 polyclonal antibody, or anti-IL-23p19 neutralizing entities described herein, were prepared in 1× HBS-EP+buffer. Duplicate injections of each concentration were performed. The analyte injections were at 30 ul/min with a dissociation time of 600 seconds. Buffer injections were also performed to allow for subtraction of instrument noise and drift.

Regeneration buffers supplied in the Regeneration Scouting Kit (GE Healthcare Biacore # BR-1005-56) were used to determine regeneration conditions. This run was performed manually, starting from the least mild condition. At the end of this procedure, the optimal regeneration condition was 60 seconds of 2M Magnesium Chloride followed with 60 seconds of 1×HBS-EP+buffer injections at a flow rate of 50 ul/min.

As a check for IL-23 specific interactions, similar procedures were followed using immobilized recombinant human IL-12 (R&D Systems).

Data were analyzed using Biacore Evaluation software (v. 1.1.1) to define the kinetic values of the interaction of IL-23 with the control proteins (IL-23p19 polyclonal antibody and IL-23R-Fc) and IL-23p19 neutralizing entities described herein. Baseline stability was assessed to ensure that the regeneration step provided a consistent binding surface throughout the sequence of injections. Binding curves were normalized by double-referencing, and duplicate injection curves were checked for reproducibility. The resulting binding curves were globally fit to the bivalent interaction model.

The data demonstrated high affinity binding of human IL-23 to the control antagonist proteins, IL-23R-Fc and anti-IL-23p19 polyclonal antibody, with affinity constants (KD) of 0.8 nM and 5.1 nM, respectively. The IL-23p19 neutralizing entities described herein were within this range. For example, clone M7.36_B06 (SQ22_c305) as an scFv had a KD (M) of $3.4 \times 10^{-8}$. There was no binding of the control IL-23 antagonist proteins or the anti-IL-23p19 neutralizing entities to IL-12, thus providing evidence for specificity of targeting IL-23.

Example 32

Off-Rate Analysis of Anti-IL-23p19 Molecules to IL-23 Via Surface Plasmon Resonance (Biacore)

Anti-IL-23p19 entities described herein were evaluated for binding off-rates to IL-23 using surface plasmon resonance and Biacore T-100 instrument (GE Healthcare). Off-rate analysis is thought to help estimate the interaction that occurs in vivo, since a slow off-rate would predict a greater degree of interaction over long period of time. For these experiments, recombinant human IL-23 was immobilized to the sensor chip, followed by passing the antagonists over the immobilized ligand to attain off-rate analyses. Similar to the Biacore affinity example (see EXAMPLE 31), IL-12 was used as the negative control, in order to demonstrate IL-23 specificity.

To determine the best conditions for immobilization, a series of pH scouting experiments were performed. For these experiments, recombinant human IL-23 (ZGI lot A1806F) was diluted to 100 nM in five different immobilization buffers; Acetate-4.0, Acetate-4.5, Acetate-5.0, Acetate-5.5, and Borate-8.5. Using immobilization scouting wizard, these conditions were tested and at the end Acetate-4.5 was the best condition for immobilization.

For the immobilization procedure, human IL-23 (native and biotinylated) and IL-12 were diluted to 10 ug/ml in Acetate-4.5. All three proteins were immobilized onto a Series S Sensor Chip (CM5, GE Healthcare/Biacore #BR-1006-68) using the amine coupling kit and Biacore Immobilization Wizard. Briefly, the level of immobilization was targeted to 300 Biacore Resonance Units (RU). Flow cell 1 was used as the reference, and therefore was only activated and then blocked with ethanolamine. The native form of IL-23 was immobilized to flow cell 2, biotinylated IL-23 was immobilized to flow cell 3 and IL-12 was immobilized to flow cell 4. Analyte was injected only over active flow cells (flow cells 2, 3 and 4). After the immobilization, the active sites on the flow cell were blocked with ethanolamine. Non-specifically bound protein was removed by washing with 50 mM NaOH. The final immobilization levels fell between 379 and 415 RU.

Samples of the anti-IL-23p19 neutralizing entities were diluted to 100 nM in 1×HBS-EP+ buffer (GE Healthcare/Biacore, #BR-1006-69). IL-23R-Fc was also prepared at 100 nM in 1×HBS-EP+buffer as a positive control. Duplicate injections of each sample were performed. The analyte injections were at 30 uL/min with dissociation time of 600 seconds. Buffer injections were also performed to allow for subtraction of instrument noise and drift.

Regeneration buffers supplied in a regeneration scouting kit were used to determine regeneration conditions (RR-2007001). Using this procedure, the optimal regeneration condition was found to be 60 seconds of 2M Magnesium Chloride followed with 60 seconds of 1×HBS-EP+buffer injections at a flow rate of 50 ul/min.

Data were evaluated using Biacore Evaluation software to define the off-rate of the interactions of anti-IL-23p19 neutralizing entities to immobilized IL-23. Baseline stability was assessed to ensure that the regeneration step provided a consistent binding surface throughout the sequence of injections. Binding curves were normalized by double-referencing. Duplicate injection curves were checked for reproducibility and the resulting binding curves were globally-fit to the bivalent interaction model.

TABLE 12a anti-IL-23p19 Fab off-rate rankings

| Sample (cluster id) | off-rate (slow to fast) |
|---|---|
| IL23 Receptor | $k_d$ = 4E−4 |
| M7.7.F5 (c87) | slow $k_d$ |
| M7.12.F9 (c29) | |
| M7.12.A7 (c103) | |
| M7.13.A6 (c103) | |
| M7.9.G9 (c36) | medium $k_d$ |
| M7.12.B9 (c41) | |
| M7.9.A7 (c27) | fast $k_d$ |
| M7.3.D4 (c101) | |

TABLE 12b anti-IL-23p19 off-rate rankings: Panel #1

| Sample (cluster id) | off-rate (slow to fast) |
|---|---|
| IL23 Receptor | $k_d$ = 4E−4 |
| M7.36.B6 (c305) | slow |
| M7.35.E9 (c303) | ↓ |

TABLE 12b-continued anti-IL-23p19 off-rate rankings: Panel #1

| Sample (cluster id) | off-rate (slow to fast) |
|---|---|
| M7.36.D3 (c304) | ↓ |
| M7.35.C9 (c302) | fast |

TABLE 12c anti-IL-23p19 scFv Off-rate Rankings

| Ranking | Clone # |
|---|---|
| 1 | M7.36_C06 |
| 1 | M7.50_C03 |
| 2 | M7.36_B03 |
| 2 | M7.66_A07 |
| 2 | M7.66_G05 |
| 3 | M7.36_A07 |
| 3 | M7.66_E06 |
| 3 | M7.67_A03 |
| 3 | M7.67_F12 |
| 3 | M7.50_D05 |
| 3 | M7.65_F07 |
| 4 | M7.66_D07 |
| 5 | M7.67_B07 |
| 5 | M7.67_G11 |
| 5 | M7.64_F07 |
| 5 | M7.50_D07 |
| 5 | M7.65_F02 |
| 5 | M7.49_A07 |
| 5 | M7.67_F11 |
| 6 | M7.67_C09 |
| 7 | M7.66_A08 |
| 7 | M7.67_G09 |
| 7 | M7.66_D08 |
| 7 | M7.49_E11 |
| 7 | M7.67_F10 |
| 8 | M7.50_D03 |
| 9 | M7.65_E09 |

Example 33

Characterization of Anti-IL-17A Fabs

Anti-IL-17A Fabs from 16 different *E. coli* clones demonstrated the ability to neutralize the activity of IL-17A in a cell-based neutralization assays. The functional binding properties of these anti-IL-17A neutralizing Fabs were additionally characterized using competitive binding (epitope binning) experiments.

Competitive Epitope Binding (Epitope Binning)

Epitope binning experiments were performed to determine which anti-IL-17A Fabs are capable of binding simultaneously to human IL-17A. Anti-IL-17A Fabs that compete for the same, or an overlapping site (epitope) on the antigen are not able to bind simultaneously and are functionally grouped into a single family or "epitope bin". Anti-IL-17A Fabs that do not compete for the same binding site on the antigen are able to bind simultaneously and are grouped into separate families or "epitope bins". Experiments were performed using a Biacore 3000™ instrument. Biacore is only one of a variety of assay formats that are routinely used to assign panels of antibody fragments and monoclonal antibodies to epitope bins. Many references (e.g. The Epitope Mapping Protocols, Methods in Molecular Biology, Volume 6,6 Glenn E. Morris ed.) describe alternative methods that can be used (by those skilled in the art) to "bin" the antibody fragments, and would be expected to provide comparable data regarding the binding characteristics of the anti-IL-17A Fabs to human IL-17A. Epitope binning experiments were performed with soluble, native antigen.

Materials and Methods

Epitope binning studies were performed on a Biacore3000™ system (Biacore, Uppsalla Sweden). Methods were programmed using Biacore Control Software, v 3.2. Human IL-17A (ZymoGenetics) was covalently immobilized to a Biacore CM5 sensor chip. Subsequently, the first anti-IL-17A Fab (primary) of a test pair was injected and allowed to specifically bind to the antigen immobilized on the sensor chip. The Biacore instrument measures the mass of protein bound to the sensor chip surface, and thus, immobilization of the antigen and specific binding of the primary Fab of a test pair were verified for each test cycle. Care was taken to confirm that all the binding sites for the primary Fab were saturated prior to exposure to the secondary anti-IL-17A Fab of the test pair. Following the binding of the primary Fab of the test pair, a secondary anti-IL-17A Fab was injected and allowed to bind to the immobilized antigen. If the secondary anti-IL-17A Fab was capable of binding the antigen simultaneously with the primary Fab, an increase in mass on the surface of the chip, or binding, was detected. If, however, the secondary anti-IL-17A Fab was not capable of binding the antigen simultaneously with the primary Fab, no additional mass, or binding, was detected. Each anti-IL-17A Fab tested against itself was used as the negative control to establish the level of the background (no-binding) signal.

A series of experiments were completed to test the binding properties of purified anti-IL-17A Fabs from 15 clones (M7.19 E7; M7.24 E5; M7.20 G6; M7.24 E8; M7.19 F4; M7.24 G6; M7.19 D10; M7.20 E5; M7.24 A5; M7.20 C10; M7.20 F11; M7.20 A9; M7.24 C2; M7.20 F4; M7.24 D8) generated against human IL-17A. IL-17A was covalently immobilized using EDC:NHS to a density of approximately 2000 RU. Previous experiments have demonstrated that this type of immobilization does not interfere with the binding of the anti-IL-17A Fabs. Each anti-IL-17A Fab was tested as the primary anti-IL-17A Fab in combination with a subset of secondary anti-IL-17A Fabs. The primary anti-IL-17A Fabs were tested at a concentration of 200 nM and a flow rate of 10 µL/min, while the secondary anti-IL-17A Fabs were tested at a concentration of 100 nM and a flow rate of 50 µL/min. Experiments were performed at 25° C. Between cycles, the antigen on the chip was regenerated with 10 mM phosphoric acid. Data was compiled using BioEvaluation 4.1 RCI software, then loaded into Excel™ for additional data processing.

Results:

A subset of the purified anti-IL-17A Fabs that bind human IL-17A were characterized and assigned into epitope bins. The signal (RU, response units) reported by the Biacore is directly correlated to the mass on the sensor chip surface. Once the level of background signal (RU) associated with the negative controls was established (a single anti-IL-17A Fab used as both the primary and secondary Fabs), the binning results were reported as either positive or negative binding. Positive binding indicates that two different anti-IL-17A Fabs are capable of binding the antigen simultaneously. Negative binding indicates that two different anti-IL-17A Fabs are not capable of binding the antigen simultaneously. The differential between positive and negative response values in this experiment was significant and allowed for an unambiguous assignment of thirteen of the anti-IL-17A Fabs into two distinct families or epitope bins. Two binding epitopes were identified within this set of neutralizing anti-IL-17A Fabs, and multiple E. coli clones were found to bind to one of the epitopes. The first epitope bin was comprised of anti-IL-17A Fabs from clones M7.19 E7; M7.20 G6; M7.24 E8; M7.19 F4; M7.19 D10; M7.20 E5; M7.24 A5; M7.20 C10; M7.20 F1; M7.20 A9; M7.24 C2; M7.20 F4. The second bin was comprised of the anti-IL-17A Fab from clone M7.24 G6.

Example 34

Characterization of Anti-IL-23p19 Fabs

Anti-IL-23p19 Fabs from 9 different E. coli clones demonstrated the ability to neutralize the activity of IL-23 in a cell-based neutralization assays. The functional binding properties of these anti-IL-23p19 neutralizing Fabs were additionally characterized using competitive binding (epitope binning) experiments.

Competitive Epitope Binding (Epitope Binning)

Epitope binning experiments were performed to determine which anti-IL-23p19 Fabs are capable of binding simultaneously to human IL-23. Anti-IL-23p19 Fabs that compete for the same, or an overlapping, binding site (epitope) on the antigen are not able to bind simultaneously and are functionally grouped into a single family or "epitope bin". Anti-IL-23p19 Fabs that do not compete for the same binding site on the antigen are able to bind simultaneously and are grouped into separate families or "epitope bins". Experiments were performed using a Biacore 3000™ instrument. Biacore is only one of a variety of assay formats that are routinely used to assign panels of antibody fragments and monoclonal antibodies to epitope bins. Many references (e.g. The Epitope Mapping Protocols, Methods in Molecular Biology, Volume 6,6 Glenn E. Morris ed.) describe alternative methods that can be used (by those skilled in the art) to "bin" the antibody fragments, and would be expected to provide comparable data regarding the binding characteristics of the anti-IL-23p19 Fabs to human IL-23. Epitope binning experiments were performed with soluble, native antigen.

Materials and Methods

Epitope binning studies were performed on a Biacore3000™ system (Biacore, Uppsalla Sweden). Methods were programmed using Biacore Control Software, v 3.2. Human IL-23 (ZymoGenetics) was covalently immobilized to a Biacore CM5 sensor chip. Subsequently, the first anti-IL-23p19 Fab (primary) of a test pair was injected and allowed to specifically bind to the antigen immobilized on the sensor chip. The Biacore instrument measures the mass of protein bound to the sensor chip surface, and thus, immobilization of the antigen and specific binding of the primary Fab of a test pair were verified for each test cycle. Care was taken to confirm that all the binding sites for the primary Fab were saturated prior to exposure to the secondary anti-IL-23p19 Fab of the test pair. Following the binding of the primary Fab of the test pair, a secondary anti-IL-23p19 Fab was injected and allowed to bind to the immobilized antigen. If the secondary anti-IL-23p19 Fab was capable of binding the antigen simultaneously with the primary Fab, an increase in mass on the surface of the chip, or binding, was detected. If, however, the secondary anti-IL-23p19 Fab was not capable of binding the antigen simultaneously with the primary Fab, no additional mass, or binding, was detected. Each anti-IL-23p19 Fab tested against itself was used as the negative control to establish the level of the background (no-binding) signal.

A single experiment was completed to test the binding properties of purified anti-IL-23p19 Fabs from 9 clones (M7.3 D4; M7.7 F5; M7.9 A7; M7.9 G9; M7.12 A7; M7.12 B9; M7.12 F9; M7.13 A6; M7.13 D7) generated against human IL-23. IL-23 was covalently immobilized using EDC:NHS to a density of approximately 2000 RU. Previous experiments have demonstrated that this type of immobilization does not interfere with the binding of the anti-IL-23p19 Fabs. Each anti-IL-23p19 Fab was tested as the primary Fab in combination with the entire panel of secondary anti-IL-23p19 Fabs. The primary anti-IL-23p19 Fabs were tested at a concentration of 210 nM and a flow rate of 10 μL/min, while the secondary anti-IL-23p19 Fabs were tested at a concentration of 60 nM and a flow rate of 50 μL/min. Experiments were performed at 25° C. Between cycles, the antigen on the chip was regenerated with 2 M MgCl2. Data was compiled using BioEvaluation 4.1 RCI software, then loaded into Excel™ for additional data processing.

Results:

A subset of the purified anti-IL-23p19 Fabs that bind human IL-23 were characterized and assigned into epitope bins. The signal (RU, response units) reported by the Biacore is directly correlated to the mass on the sensor chip surface. Once the level of background signal (RU) associated with the negative controls was established (a single anti-IL-23p19 Fab used as both the primary and secondary Fabs), the binning results were reported as either positive or negative binding. Positive binding indicates that two different anti-IL-23p19 Fabs are capable of binding the antigen simultaneously. Negative binding indicates that two different anti-IL-23p19 Fabs are not capable of binding the antigen simultaneously. The differential between positive and negative response values in this experiment was significant and allowed for an unambiguous assignment of six of the anti-IL-23p19 Fabs into two distinct families or epitope bins. Two binding epitopes were identified within this set of neutralizing anti-IL-23p19 Fabs, and multiple *E. coli* clones were found to bind to each epitope. The first epitope bin was comprised of anti-IL-23p19 Fabs from clones M7.12 B9; M7.9 G9; and M7.13 D7. The second bin was comprised of anti-IL-23p19 Fabs from clone M7.7 F5; M7.12 A7; and M7.13 A6.

Example 35

Determination of Ability of Anti-Human IL-17A Neutralizing Entities to Cross-React and Neutralize Cynomolgous Monkey IL-17A-Induced Activity in IL-17A Bioassays Species cross-reactivity studies (especially for non-human primate cross-reactivity) are an important activity to demonstrate for therapeutic antagonist development strategies. In order to determine whether the anti-human IL-17A neutralizing entities described herein may cross-react and neutralize the activity induced by cynomolgous IL-17A (and therefore, justify the cynomolgous monkey as a viable test species), it was first necessary to demonstrate comparable activities induced by both recombinant human and cynomolgous monkey IL-17A in the bioassays employed here for testing neutralization. The methods for IL-17A activity assays described in EXAMPLES 5, 23 and 27 were used with a full range (0-112 nM) of either recombinant human IL-17A (ZGI lot A178 1F) or recombinant cynomolgous IL-17A (ZGI lot A1906F). Results indicate that the activity induced by the human and cynomolgous IL-17A proteins used here were nearly identical in all three assays, yielding indistinguishable curves and EC50 values (identical between species for each experiments, and ranged from 0.22-0.41 nM amongst independent replicate experiments performed on different days).

Inclusion of the human IL-17RA-Fc was able to neutralize the effects of either human IL-17A or cynomolgous IL-17A with IC50 values nearly identical for either species (i.e. 2.9 nM for neutralization against human IL-17A and 2.8 nM for cynomolgous IL-17A) in the method outlined in EXAMPLE 5. The IL-17A neutralizing entities described herein were also tested for species cross-reactivity of neutralizing ability and though there was a range of neutralizing capabilities, the antagonists that worked best to neutralize human IL-17A were also able to effectively neutralize activity induced by cynomologous IL-17A. For example, in the human SAEC bioassay (described in EXAMPLE 27) clone M7.19.E7 (SQ7_c87) had an IC50 of 31.1 nM to inhibit human IL-17A induced G-CSF production, and this same clone had an IC50 of approximately 90 nM to inhibit cynomolgous IL-17A induced G-CSF production. Therefore, although the IC50 values were higher against cynomolgous IL-17A activity compared to human IL-17A, there was clearly species cross-reactivity in the ability of the anti-IL-17A neutralizing entities to inhibit IL-17A-mediated biological activity.

Example 36

Determination of Ability of Anti-Human IL-23 Neutralizing Entities to Cross-React and Neutralize Cynomolgous Monkey IL-23-Induced Activity in IL-23 Bioassays Similar experiments as described above in EXAMPLE XX (Cynomolgous IL-17A experiments) were performed with human versus cynomolgous IL-23, using IL-23 activity assays described in EXAMPLES 24 and 26, using a full range (0-4050 μM) of either recombinant human IL-23 (ZGI lot A1806F) or recombinant cynomolgous IL-23 (ZGI lot A1922F). Results indicated that the activities induced by these two species of IL-23 were identical for the luciferase-based assay (EC50, in one experiment for example, of 85 μM for both species of IL-23) and nearly identical for the pSTAT3-based assay (46 and 39 μM for human and cynomolgous IL-23 EC50 values, respectively).

In experiments designed to evaluate the ability of the IL-23 neutralizing entities described herein to neutralize both human and cynomolgous IL-23, results were similar to those described above for cynomolgous IL-17A: i.e. although there was a range of neutralizing capacities, those that neutralized human IL-23 best also showed the best neutralization against cynomolgous IL-23-induced activity. For example, in the IL23R/IL12Rb1 transfectant bioassay (EXAMPLE 24), clone M7.36_B06 (SQ22_c305) as a scFv was able to neutralize human IL-23-mediated pSTAT3 activity with an IC50 of 0.13 nM and neutralized cynomolgous IL-23-mediated pSTAT3 activity with an IC50 of 0.077 nM. These results demonstrated cynomolgous monkey cross-reactivity for the ability to inhibit IL-23-mediated biological activity.

Example 37

IL-23 Expression Construct

An expression plasmid was constructed via homologous recombination using two DNA fragments, one containing the sequence for pIL12B and one containing the sequence for pIL23A, and the expression vector pZMP42. The pIL12B fragment was generated by PCR amplification using primers zc56242 and zc56243. The pIL23A fragment was generated by PCR amplification using primers zc56244 and zc56245.

The pIL12B fragment was made using a previously generated clone of pIL12B as the template. The fragment includes a 5' overlap with the pZMP42 vector sequence, the pIL12B segment, and a linker sequence designed to join pIL12B to pIL23A. The pIL23A fragment was made using a previously generated clone of pIL23A as the template. The fragment includes a linker sequence designed to join pIL23A to pIL12B, the pIL23A segment, and a 3' overlap with the pZMP42 vector sequence. PCR conditions used were as follows: 1 cycle, 94° C., 5 minutes; 35 cycles, 94° C., 1 minute, followed by 58° C., 2 minutes, followed by 72° C., 3 minutes; 1 cycle, 72° C., 10 minutes.

The PCR reaction mixtures were run on a 1% agarose gel and a band corresponding to the sizes of the inserts were gel-extracted using a QIAquick™ Gel Extraction Kit (Qiagen, Cat. No. 28704).

Plasmid pZMP42 is a mammalian expression vector containing an expression cassette having the MPSV promoter, multiple restriction sites for insertion of coding sequences, and an otPA signal peptide sequence; an internal ribosome entry site (IRES) element from Hepatitis C virus, and the extracellular domain of CD8 truncated at the C-terminal end of the transmembrane domain; an internal ribosome entry site (IRES) element from poliovirus, a DHFR gene, and the SV40 terminator; an E. coli origin of replication; and URA3 and CEN-ARS sequences required for selection and replication in S. cerevisiae. It was constructed from pZMP21 (Patent Pub. No. US 2003/0232414 A1) (deposited at the American Type Culture Collection, 10801 University Boulevard, Manassas, Va. 20110-2209, designated as ATCC# PTA-5266).

The plasmid pZMP42 was cut with BglII prior to recombination in yeast with the PCR fragment. One hundred microliters of competent yeast (S. cerevisiae) cells were independently combined with 10 µl of the insert DNA and 10 ng of cut pZMP42 vector, and the mix was transferred to a 0.2-cm electroporation cuvette. The yeast/DNA mixture was electropulsed using power supply (BioRad Laboratories, Hercules, Calif.) settings of 0.75 kV (5 kV/cm), ∞ ohms, and 25 µF. Six hundred µl of 1.2 M sorbitol was added to the cuvette, and the yeast was plated in a 100-µl and 300p aliquot onto two URA-D plates and incubated at 30° C. After about 72 hours, the Ura+ yeast transformants from a single plate were resuspended in 1 ml $H_2O$ and spun briefly to pellet the yeast cells. The cell pellet was resuspended by vortex in 0.1 ml of lysis buffer (2% Triton X-100, 1% SDS, 100 mM NaCl, 10 mM Tris, pH 8.0, 1 mM EDTA), and 0.1 mL of P1 (from QIAprep Spin Miniprep Kit, Qiagen, cat# 27106) with 10 units of Zymolyase added (Zymo Research, cat# E1002). The yeast suspension was incubated for 10 minutes in a 37° C. waterbath. DNA from the yeast was isolated using the standard QIAprep Spin Miniprep Kit protocol (Qiagen, cat# 27106), starting at the step of adding reagent P2.

Transformation of electrocompetent E. coli host cells (DH12S) was done using 5 µl of the yeast DNA prep and 50 µl of cells. The cells were electropulsed at 2.0 kV, 25 PF, and 400 ohms. Following electroporation, 1 ml SOC (2% Bacto™ Tryptone (Difco, Detroit, Mich.), 0.5% yeast extract (Difco), 10 mM NaCl, 2.5 mM KCl, 10 mM $MgCl_2$, 10 mM $MgSO_4$, 20 mM glucose) was added and then the cells were plated in a 50 µl and a 200 µl aliquot on two LB AMP plates (LB broth (Lennox), 1.8% Bacto™ Agar (Difco), 100 mg/L Ampicillin).

The inserts of five clones for the construct were subjected to sequence analysis and one clone, containing the correct sequence, was selected. Larger scale plasmid DNA was isolated using a commercially available kit (QIAGEN Plasmid Mega Kit, Qiagen, Valencia, Calif.) according to manufacturer's instructions.

Three sets of 200 µg of the zCyto38f2 construct were each digested with 200 units of Pvu I at 37° C. for three hours and then were precipitated with IPA and spun down in a 1.5 mL microfuge tube. The supernatant was decanted off the pellet, and the pellet was washed with 1 mL of 70% ethanol and allowed to incubate for 5 minutes at room temperature. The tube was spun in a microfuge for 10 minutes at 14,000 RPM and the supernatant was decanted off the pellet. The pellet was then resuspended in 750 µl of ZF1 media in a sterile environment, allowed to incubate at 60° C. for 10 minutes, and was allowed to cool to room temperature. 5E6 5×SA cells were spun down in each of three tubes and were resuspended using the DNA-media solution. The DNA/cell mixtures were placed in a 0.4 cm gap cuvette and electroporated using the following parameters: 950 µF, high capacitance, and 300 V. The contents of the cuvettes were then removed, pooled, and diluted to 25 mLs with ZF1 media and placed in a 125 mL shake flask. The flask was placed in an incubator on a shaker at 37° C., 6% $CO_2$, and shaking at 120 RPM.

The cell line was subjected to nutrient selection followed by step amplification to 200 nM methotrexate (MTX). Expression was confirmed by western blot, and the cell line was scaled-up and protein purification followed.

Example 38

Expression of IL23 C-terminal His tagged Protein in CHO DXB11 Cells in a Wave Reactor IL23 v.1 CH6 protein (IL23A/IL12B) was expressed in a 20 L Wavebag Reactor (Wave Biotech) in CHO DXB11 cells transfected with the ZG construct 1564. The cells were scaled up in shake flasks using ZF1 medium (JRH imMEDIAte Advantage Cat# 65633) with the addition of 5 mM L-glutamine (from 200 mM L-glutamine, Gibco catalog #25030-081), 1 mM sodium pyruvate (from 100 mM Sodium Pyruvate, Gibco catalog #11360-070) and 500 nM methotrexate. The reactor run was initiated by seeding 1.7 L of shake flask culture in log phase into 8.3 L ZF1 medium containing L-glutamine and sodium pyruvate but no methotrexate. This resulted in a 10 L final working volume with a density of 3.1×10E5 c/mL.

The $CO_2$ level was maintained at 6% and was pumped continually into the headspace of the reactor at 0.1 LPM. Dissolved oxygen requirements of the cells were met by rocking the culture on a platform at a rate of 25 rocks per minute at an angle setting of 9.5. pH was not controlled but stayed between 6.6 and 6.9. Temperature was maintained at 37° C. until density reached 7.5×10E5 cells/mL, then temperature was dropped to 34° C. for the remainder of the run. Glucose levels were maintained above 2 g/L and L-glutamine above 2 mM.

The culture was harvested 9 days after seeding with a density of 4.7×10E6 cells/mL and 97% viability. The supernatant was centrifuged at 3500×g for 15 minutes and the clarified conditioned medium was passed through a 0.22 µm filter (Millipore Opticap Cat# KW1904HB3) and submitted for protein purification.

Example 39

Transfection and Expression of Cyno IL23 Protein in 293 Cells

Cynomolgus IL23 was produced transiently in 293F cells (Invitrogen, Carlsbad, Calif. Cat# R790-07). Large-scale plasmid DNA was isolated using a PureLink HiPure Plasmid Gigaprep Kit (Invitrogen, Carlsbad, Calif. Cat# K210009) according to manufacturer's instructions. 293F suspension cells were cultured in 293 Freestyle medium (Invitrogen, Carlsbad, Calif. Cat# 12338-018) at 37° C., 6% CO2 in four 3 L spinner flasks at 95 RPM. Fresh medium was added to each spinner immediately prior to transfection to obtain a 1.5 liter working volume at a final density of 1×10E6 cells/mL. For each spinner, 2.0 mL of Lipofectamine 2000 (Invitrogen, Carlsbad, Calif. Cat# 11668-019) was added to 20 mL Opti-MEM medium (Invitrogen, Carlsbad, Calif. Cat# 31985-070) and 1.5 mg of DNA (ZG Construct 1630) was diluted in a separate tube of 20 mL Opti-MEM. For each spinner, the DNA and lipid were incubated separately at room temperature for 5 minutes, then combined and incubated together for an additional 30 minutes at room temperature with occasional gentle mixing. One tube of lipid-DNA mixture was added to each spinner of 293F cells which was returned to 37° C., 6% CO2 at 75 RPM. After approximately 96 hours, the conditioned medium was harvested, 0.2 µM filtered and submitted for protein purification.

Example 40

LL-23 Protein Purification

A) Purification of Human IL-23

Preparation of Human IL23 v.1 for IMAC Capture—
~10 L of 1× media were augmented to 0.02% sodium azide from 1000× stock and put through a UF/DF process wherein the media was first concentrated 10× against 3×0.1 m210 kD Pellicon membranes (Millipore) in a peristaltic pump system. Then the concentrate was diafiltered into phosphate buffered saline via 5 system volume exchanges. Harvested UF/DF media was adjusted to 0.5M NaCl (via addition of 0.4M Solid), 25 mM Imidazole (addition of solid) and the pH adjusted to 7.5 (using HCl). The adjusted concentrate was 0.22 um sterile filtered (Nalgene) and analyzed via RP-HPLC and Western blot for recovery, comparing against 1× media and the permeates. Analyses show that target is nearly completely recovered at this step.

IMAC (Immobilized Metal Affinity Chromatography) Capture—
UF/DF media was loaded over 137 mL Ni NTA His Bind Resin (Novagen) packed in a 2 cm glass column (Millipore) at 0.2 mL/min at 4 C. The column was equilibrated in 500 mM NaCl, 50 mM NaPO$_4$, 25 mM Imidaozloe pH 7.5 buffer. Upon complete washout of the applied media, the flow rate was increased to 20 mL/min and the column washed with equilibration buffer until UV at 254 nm and 280 nm was baseline stable. Bound protein was eluted stepwise using a 40 mM and 500 mM Imidazole steps, each in equilibration buffer. The elution flow rate was 20 mL/min and 25 mL fractions were collected. Pools were made based on the inflection of A280 nm and analyzed by RP-HPLC, as well as reducing and non-reducing SDS-PAGE coomassie gels. Only the 500 mM pool had target as analyzed by these methods. Protein was completely captured by the IMAC resin, as assessed by Western blot and RP-HPLC.

Superdex 200 Coarse SEC (Size Exclusion Chromatography)
The 500 mM IMAC pool was considered pure enough to warrant SEC for final formulation and polishing. The pool was initially concentrated to 50 mL against 1×50 cm$^2$ 100 kD MWCO membrane (Millipore) in the Labscale TFF system. At 50 mL, this concentrate was transferred to a 30 kD Ultracel membrane (Millipore). Concentration continued via centrifugation until a final volume of 15 mL was reached. The final concentrate was injected over a 26/60 (318 mL) Superdex 200 size exclusion column (GE Healthcare) running in 35 mM NaPO4, 120 mM NaCl pH 7.2 at 3.0 mL/min. 2.5 mL fractions were collected throughout the isocratic elution. A total of three runs were performed, with 6 mL injections per run. Elution fractions were analyzed by SDS-PAGE non-reducing gel, and the resulting pools were analyzed by RP-HPLC. Monomeric protein was selectively pooled.

Superdex 200 Fine SEC (Size Exclusion Chromatography)
The pools of protein from the first size exclusion run were slightly contaminated with higher molecular weight species. They were pooled together, and re-concentrated to <10 mL against 63.5 mm YM30 stirred cell membrane (Millipore). The concentrate was re-injected over the Superdex 200 size exclusion column under identical conditions as previous. A conservative pool was made based on the UV absorbance inflection at 280 nm, and assayed by RP-HPLC for a putative target concentration. This final pool was 0.22 um filtered (Millipore), aliquoted, and stored at −80 C.

B) Purification of Cyno IL23 v.4 from 293F Transient Host—IMAC Capture—
~5.8 L of delivered media was concentrated to <1 L against 1×0.1 m2 MWCO pellicon membrane (Millipore) using a peristaltic pump system. The conductivity of the concentrated media was adjusted to be equivalent to that of 0.5M NaCl via addition of 0.4M solid reagent, 25 mM Imidazole via addition of solid, pH 7.5 using HCl and loaded over 5 mL Ni Sepharose 6 FF resin (GE Healthcare) packed in a 1 cm diameter glass column (Millipore) at 0.9 mL/min overnight at 4 C. Upon depletion of media, flow rate increased to 4 mL/min and the column washed with 50 mM NaPO4, 500 mM NaCl, 25 mM Imidazole pH 7.5 until UV at A254 nm and A280 nm baseline stable. Bound target eluted using steps of 40 mM and 500 mM Imidazole in the above mentioned equilibration buffer. Elution proceeded at 2 mL/min, collecting 3 mL fractions throughout. Pooling of protein was based on the A280 nm inflection of the 500 mM step, and pool target concentration was analyzed via RP-HPLC.

Superdex 200 SEC
500 mM Imidazole Pool considered pure enough to warrant size exclusion chromatography for final formulation and polishing. The Ni Sepharose protein pool was concentrated to <3.0 mL against a 30 kD MWCO Ultracel membrane (Millipore). The concentrate was injected over 16/60 (120 mL) Superdex 200 size exclusion column (GE Healthcare) equilibrated in 35 mM NaPO4, 120 mM NaCl pH 7.2 at 1.02 mL/min flowrate. Fractions (1.0 mL) were collected throughout the isocratic elution. Conservative pooling was based on the inflection of the A280 nm signal. The size exclusion pool was concentrated to 2 mL using another 30 kD MWCO Ultracel membrane, 0.22 um filtered (Millipore), aliquotted, and stored at −80 C.

Example 41

Expression of IL23R Fc-Tagged Protein in CHO DXB11 Cells in a Wave Reactor

IL23R Fc5 protein was expressed in a 20 L Wavebag Reactor (Wave Biotech) in CHO DXB11 cells transfected with the ZG construct 1602. The cells were scaled up in shake flasks using ZF1 medium (JRH imMEDIAte Advantage Cat# 65633) with the addition of 5 mM L-glutamine (from 200 mM L-glutamine, Gibco catalog #25030-081), 1 mM sodium pyruvate (from 100 mM Sodium Pyruvate, Gibco catalog #11360-070) and 500 nM methotrexate. The reactor run was initiated by seeding 900 mL of shake flask culture in log phase into 9.1 L ZF 1 medium containing L-glutamine and sodium pyruvate but no methotrexate. This resulted in a 10 L final working volume with a density of 2.0×10E5 c/mL.

The $CO_2$ level was maintained at 6% and was pumped continually into the headspace of the reactor at 0.1 LPM. Dissolved oxygen requirements of the cells were met by rocking the culture on a platform at a rate of 25 rocks per minute at an angle setting of 9.5. pH was not controlled. Temperature was maintained at 37° C. until density reached approximately 8×10E5 cells/mL, then temperature was dropped to 34° C. for the remainder of the run. Glucose levels were maintained above 2 g/L and L-glutamine above 2 mM.

The culture was harvested 9 days after seeding with a density of 8.0×10E6 cells/mL and 98% viability. The supernatant was centrifuged at 3500×g for 15 minutes and the clarified conditioned medium was passed through a 0.22 μm filter (Millipore Opticap Cat# KW1904HB3) and submitted for protein purification.

Example 42

Purification of Human IL23R-Fc5 from CHO Cells

Recombinant carboxyl terminal Fc5 tagged human IL23R was produced from transfected CHO cells expressing target at 12 mg/L. The CHO transfections were performed using methods known in the art. 10 L of conditioned media were harvested, sterile filtered using 0.2 μm filters and adjusted to pH 7.4. The protein was purified from the filtered media using a combination of POROS® A50 Protein A Affinity Chromatography (Applied Biosciences, Foster City, Calif.) and Superdex 200 Size Exclusion Chromatography (GE Healthcare, Piscataway, N.J.) A 27 ml POROS® A50 column (20 mm×85 mm) was pre-eluted with 3 column volumes (CV) of 25 mM Citrate-Phosphate (1.61 mM Sodium Citrate—23.4 mM Sodium Phosphate,) 250 mM Ammonium Sulfate pH 3 buffer and equilibrated with 20 CV PBS. Direct loading to the column at 8 ml/min overnight at 4° C. captured the IL23R-Fc5 in the conditioned media. After loading was complete, the column was washed with 10 CV of equilibration buffer. Next the column was washed with 10 CV of 25 mM Citrate—Phosphate, 250 mM Ammonium Sulfate pH 7.4 buffer following which the bound protein was eluted at 10 ml/min with a 5 CV gradient from pH 7.4 to pH 3 formed using the Citrate-Phosphate-Ammonium Sulfate buffers. Fractions of 5.0 ml each were collected into tubes containing 500 1p of 2.0 M Tris, pH 8.0 and mixed immediately in order to neutralize the eluted proteins. The fractions were pooled based on A280 and non-reducing SDS-PAGE.

The IL23R-Fc5-containing pool was concentrated to 10 ml by ultrafiltration using Amicon Ultra-15 30K NWML centrifugal devices (Millipore), and injected onto a 318 ml (26 mm×600 mm) Superdex 200 column pre-equilibrated in 35 mM Sodium Phosphate, 120 mM NaCl pH 7.3 at 28 cm/hr. The fractions containing purified IL23R-Fc5 were pooled based on A280 and SDS PAGE, filtered through a 0.2 μm filter and frozen as aliquots at −80° C. The concentration of the final purified protein was determined by BCA assay (Pierce, Rockford, Ill.). The overall process recovery was approximately 66%.

Analysis of Purified IL23R-Fc5

Recombinant IL23R-Fc5 was analyzed by SDS-PAGE (4-12% BisTris, Invitrogen, Carlsbad, Calif.) with 0.1% Coomassie R250 staining for protein and immunoblotting with Anti-IgG-HRP. The purified protein was electrophoresed and transferred to nitrocellulose (0.2 μm; Invitrogen, Carlsbad, Calif.) at ambient temperature at 600 mA for 45 minutes in a buffer containing 25 mM Tris base, 200 mM glycine, and 20% methanol. The filters were then blocked with 10% non-fat dry milk in 50 mM Tris, 150 mM NaCl, 5 mM EDTA, 0.05% Igepal (TBS) for 15 minutes at room temperature. The nitrocellulose was quickly rinsed, and the IgG-HRP antibody (1:10,000) was added. The blots were incubated overnight at 4° C., with gentle shaking. Following the incubation, the blots were washed three times for 10 minutes each in TBS, and then quickly rinsed in $H_2O$. The blots were developed using commercially available chemiluminescent substrate reagents (Roche LumiLight), and the signal was captured using Lumi-Imager's Lumi Analyst 3.0 software (Boehringer Mannheim GmbH, Germany.) The purified IL23R-Fc5 appeared as a band at about 200 kDA on both the non-reducing Coomassie stained gel and on the immunoblot, suggesting a glycosylated dimeric form as expected. The protein had the correct $NH_2$ terminus and the correct amino acid composition.

Example 43

Cynomolgus IL17A CH6 Expression in 293F

An expression plasmid encoding cynomolgus IL 17A CH6 was constructed via homologous recombination in yeast with a DNA fragment containing the IL17A CH6 sequence.

A cDNA fragment was created using PCR and includes residues 1-465. The upstream primer consists of 41 bases of overlap with the vector backbone and 24 bases of the 5' end open reading from of the amino terminus of the inserted gene. The downstream primer contains 37 residues of overlap with the backbone vector, the His tag with a GSGG linker, and 23 bases of the gene.

Amino acid 127 was mutated from R to P to eliminate a potential cleavage site. This mutation converts the cynomolgus sequence to the human sequence at this position. The mutation was created by overlapping two fragments via PCR. zc57312, as explained above, was used with a 24 base downstream primer with its 5' end at amino acid 127 and its 3' end 134. This created the 5' fragment of the gene containing the mutation. The 3' fragment was constructed using a forward primer containing the entire sequence from amino acids 126 to 155. This was overlapped with primer zc57313, described previously. These two fragments were fused via PCR.

The PCR amplification conditions, using Promega's GoTaq (Promega, Madison, Wis., catalog #M712B), were as follows: 1 cycle of 94° C., 5 minutes; 29 cycles of 94° C. for 1 minute, 55° C. for 30 seconds, 68° C. for 30 seconds; 1 cycle of 4° C. forever. The entire product of each PCR was run on a 1% LMP agarose gel (Seaplaque GTG) with 1× TAE buffer for analysis. After excising the appropriate band, it was purified using Qiagen's gel purification kit (Qiagen, Valencia, Calif., catalog #28704).

One hundred μL of competent yeast cells (S. cerevisiae) was combined with 101P of purified DNA from above, mixed with 100 ng of BglII-cut plasmid, and transferred to a 0.2 cm electroporation cuvette. The yeast-DNA mixture was electropulsed at 0.75 kV (5 kV/cm), cc ohms, 25 pF. To each cuvette was added 600p of 1.2M sorbitol, and the yeast were plated onto a URA-DS plate and incubated at 30° C. After about 72 hours, approximately 50 μL packed yeast cells taken from the Ura+yeast transformants of a single plate was resuspended in 100 μL of lysis buffer (2% Triton X-100, 1% SDS, 100 mM NaCl, 10 mM Tris, pH 8.0, 1 mM EDTA), 100 μL of Qiagen P1 buffer from a Qiagen miniprep kit (Qiagen, Valencia, Calif., catalog #27104), and 20U of Zymolyase (Zymo Research, Orange, Calif., catalog #1001). This mixture was incubated for 30 minutes at 37° C., and the remainder of the Qiagen miniprep protocol was performed, using 30 uL buffer EB for elution.

Forty µL electrocompetent *E. coli* cells (DH12S, Invitrogen, Carlsbad, Calif.) was transformed with 3 µL yeast DNA in a 0.2 cm electroporation cuvette. The cells were electropulsed at 1.75 kV, 25 pF, and 400 ohms. Following electroporation, 600 µL SOC (2% Bacto' Tryptone (Difco, Detroit, Mich.), 0.5% yeast extract (Difco), 10 mM NaCl, 2.5 mM KCl, 10 mM MgCl2, 10 mM MgSO4, 20 mM glucose) was added to the cuvette. 10 µL of this solution was plated on an LB AMP plate (LB broth (Lennox), 1.8% Bacto Agar (Difco), 100 mg/L Ampicillin).

Individual clones harboring the correct expression construct for cynomolgus IL17A CH6 were identified by restriction digest with 20U FspI and 20U PvuII to verify the presence of the insert. The inserts of positive clones were subjected to sequence analysis. Larger scale plasmid DNA was isolated using the Invitrogen mega prep kit (Invitrogen, Carlsbad, Calif., catalog #457009) according to manufacturer's instructions.

Transfection into 293F Cells:

To test for expression of the cynomolgus IL17A CH6 protein, 293F cells were transiently transfected using Lipofectamine-2000 (Invitrogen, Carlsbad, Calif., catalog #11668-019) and OptiMEM (Invitrogen, Carlsbad, Calif., catalog #31985-070) and grown in a 12-well plate. 1 pg plasmid DNA and one million cells were used for the transfection. After 96 hours, medium was harvested and prepared for a Western blot assay.

Invitrogen materials and protocols were used for the Western blot with anti-6× histidine (R&D Systems, Minneapolis, Minn., catalog #MAB050H) as the detection antibody. Significant expression was observed, so a large scale transfection was done for protein acquisition.

Six 1000 mL flasks were seeded with 250 mL 293F cells at one million cells per mL. 20 mL OptiMEM was placed in each of two 50 mL conical tubes. 2 mL Lipofectamine-2000 was added to one 50 mL conical tube and 1.5 mg of the cynomolgus IL17A CH6 expression plasmid was placed in the other tube. The tubes were inverted several times and allowed to incubate for 5 minutes at room temperature. The two tubes were then mixed together, inverted several times, and allowed to incubate for 30 minutes at room temperature. While swirling the cells, the DNA-Lipofectamine2000 mixture was evenly distributed into each of the six flasks. The flasks were then incubated on a shaker at 37° C., 6% $CO_2$, and shaken at 120 rpm. Cells were harvested 96 hours later.

The DNA sequence is shown in SEQ ID NO: 1018. The polypeptide sequen is shown in SEQ ID NO: 1019.

Example 44

Transfection and Expression of Cyno IL17A C-terminal His-Tagged Protein in 293 Cells Cynomolgus IL17A R127P CH6 was produced transiently in 293F cells (Invitrogen, Carlsbad, Calif. Cat# R790-07). Briefly, 293F suspension cells were cultured in 293 Freestyle medium (Invitrogen, Carlsbad, Calif. Cat# 12338-018) at 37° C., 6% CO2 in a 3 L spinner flask at 95 RPM. Fresh medium was added immediately prior to transfection to obtain a one liter working volume at a final density of 1×10E6 cells/ml. For each spinner, 1.3 mL of Lipofectamine 2000 (Invitrogen, Carlsbad, Calif. Cat# 11668-019) was added to 15 mL Opti-MEM medium (Invitrogen, Carlsbad, Calif. Cat# 31985-070) and 1.0 mg of DNA (ZG Construct 1623) was diluted in a separate tube of 15 mL Opti-MEM. Each tube was incubated separately at room temperature for 5 minutes, then combined and incubated together for an additional 30 minutes at room temperature with occasional gentle mixing. The lipid-DNA mixture was then added to the spinner of 293F cells which was returned to 37° C., 6% CO2 at 75 RPM. After approximately 96 hours, the conditioned medium was harvested, 0.2 µM filtered and submitted for protein purification.

Example 45

Cynomolgus IL17F CH6 Expression in 293F

An expression plasmid encoding cynomolgus IL17F CH6 was constructed via homologous recombination in yeast with a DNA fragment containing the IL17F CH6 sequence.

A cDNA fragment was created using PCR and includes residues 1-522. The upstream primer consists of 42 bases of overlap with the vector backbone and 24 bases of the 5' end open reading from of the amino terminus of the inserted gene. The downstream primer contains 37 residues of overlap with the backbone vector, the His tag with a GSGG linker, and 23 bases of the gene.

The PCR amplification conditions, using Promega's GoTaq (Promega, Madison, Wis., catalog #M712B), were as follows: 1 cycle of 94° C., 5 minutes; 29 cycles of 94° C. for 1 minute, 55° C. for 30 seconds, 68° C. for 30 seconds; 1 cycle of 4° C. forever. The entire product of each PCR was run on a 1% LMP agarose gel (Seaplaque GTG) with 1×TAE buffer for analysis. After excising the appropriate band, it was purified using Qiagen's gel purification kit (Qiagen, Valencia, Calif., catalog #28704).

One hundred µL of competent yeast cells (*S. cerevisiae*) was combined with 10 µl of purified DNA from above, mixed with 100 ng of BglII-cut plasmid, and transferred to a 0.2 cm electroporation cuvette. The yeast-DNA mixture was electropulsed at 0.75 kV (5 kV/cm), cc ohms, 25 pF. To each cuvette was added 600p of 1.2M sorbitol, and the yeast were plated onto a URA-DS plate and incubated at 30° C. After about 72 hours, approximately 50 µL packed yeast cells taken from the Ura+yeast transformants of a single plate was resuspended in 100 µL of lysis buffer (2% Triton X-100, 1% SDS, 100 mM NaCl, 10 mM Tris, pH 8.0, 1 mM EDTA), 100 µL of Qiagen P1 buffer from a Qiagen miniprep kit (Qiagen, Valencia, Calif., catalog #27104), and 20U of Zymolyase (Zymo Research, Orange, Calif., catalog #1001). This mixture was incubated for 30 minutes at 37° C., and the remainder of the Qiagen miniprep protocol was performed, using 30 uL buffer EB for elution.

Forty µL electrocompetent *E. coli* cells (DH12S, Invitrogen, Carlsbad, Calif.) was transformed with 3 µL yeast DNA in a 0.2 cm electroporation cuvette. The cells were electropulsed at 1.75 kV, 25 pF, and 400 ohms. Following electroporation, 600 µL SOC (2% Bacto' Tryptone (Difco, Detroit, Mich.), 0.5% yeast extract (Difco), 10 mM NaCl, 2.5 mM KCl, 10 mM MgCl2, 10 mM MgSO4, 20 mM glucose) was added to the cuvette. 10 µL of this solution was plated on an LB AMP plate (LB broth (Lennox), 1.8% Bacto Agar (Difco), 100 mg/L Ampicillin).

Individual clones harboring the correct expression construct for cynomolgus IL17F CH6 were identified by restriction digest with 20U FspI and 20U BsrGI to verify the presence of the insert. The inserts of positive clones were subjected to sequence analysis. Larger scale plasmid DNA was isolated using the Invitrogen mega prep kit (Invitrogen, Carlsbad, Calif., catalog #457009) according to manufacturer's instructions.

Transfection into 293F Cells:

To test for expression of the cynomolgus IL17F CH6 protein, 293F cells were transiently transfected using Lipofectamine2000 (Invitrogen, Carlsbad, Calif., catalog #11668-019) and OptiMEM (Invitrogen, Carlsbad, Calif., catalog #31985-070) and grown in a 12-well plate. 1 pg plasmid DNA and one million cells were used for the transfection. After 96 hours, medium was harvested and prepared for a Western blot assay.

Invitrogen materials and protocols were used for the Western blot with anti-6x histidine (R&D Systems, Minneapolis, Minn., catalog #MAB050H) as the detection antibody. Significant expression was observed, so a large scale transfection was done for protein acquisition.

Six 1000 mL flasks were seeded with 250 mL 293F cells at one million cells per mL. 20 mL OptiMEM was placed in each of two 50 mL conical tubes. 2 mL Lipofectamine2000 was added to one 50 mL conical tube and 1.5 mg of the cynomolgus IL17F CH6 expression plasmid was placed in the other tube. The tubes were inverted several times and allowed to incubate for 5 minutes at room temperature. The two tubes were then mixed together, inverted several times, and allowed to incubate for 30 minutes at room temperature. While swirling the cells, the DNA-Lipofectamine2000 mixture was evenly distributed into each of the six flasks. The flasks were then incubated on a shaker at 37° C., 6% $CO_2$, and shaken at 120 rpm. Cells were harvested 96 hours later.

The DNA sequence is shown in SEQ ID NO: 1020. The polypeptide sequen is shown in SEQ ID NO: 1021.

Example 46

Transfection and Expression of Cyno IL17F C-terminal His-Tagged Protein in 293 Cells Cynomolgus IL17F CH6 was produced transiently in 293F cells (Invitrogen, Carlsbad, Calif. Cat# R790-07). Briefly, 293F suspension cells were cultured in 293 Freestyle medium (Invitrogen, Carlsbad, Calif. Cat# 12338-018) at 37° C., 6% CO2 in a 3 L spinner flask at 95 RPM. Fresh medium was added immediately prior to transfection to obtain a one liter working volume at a final density of 1×10E6 cells/mL. For each spinner, 1.3 mL of Lipofectamine 2000 (Invitrogen, Carlsbad, Calif. Cat# 11668-019) was added to 15 mL Opti-MEM medium (Invitrogen, Carlsbad, Calif. Cat# 31985-070) and 1.0 mg of DNA (ZG Construct 1628) was diluted in a separate tube of 15 mL Opti-MEM. Each tube was incubated separately at room temperature for 5 minutes, then combined and incubated together for an additional 30 minutes at room temperature with occasional gentle mixing. The lipid-DNA mixture was then added to the spinner of 293F cells which was returned to 37° C., 6% CO2 at 75 RPM. After approximately 96 hours, the conditioned medium was harvested, 0.2 µM filtered and submitted for protein purification.

Example 47

Purification of cyno IL17A R127P CH6 and cyno IL17F CH6

Ni IMAC Capture—

Delivered media was adjusted to 0.5M NaCl and 25 mM Imidazole via addition of solid, pH 7.5 via slowly adding 10N NaOH while stirring. Adjusted media was loaded over 5 mL Ni Sepharose 6 FF resin (GE Healthcare) packed in a 1.0 cm diameter column (Millipore) at 0.9 mL/min overnight at 4 C.

Upon depletion of media, the flow rate was increased to 4 mL/min and the column washed with 50 mM NaPO4, 500 mM NaCl, 25 mM Imidazole pH 7.5 until UV@A254 nm and A280 nm was baseline stable. Bound target was eluted using steps of 40 mM and 500 mM Imidazole in the above mentioned equilibration buffer. Elution proceeded at 2 mL/min, collecting 3 mL fractions throughout. Only fractions from the 500 mM Imidazole step contained target, a pool was made based on the 280 nm absorbance inflection and analyzed by RP-HPLC. By analytical RP-HPLC, the entire expressed CH6 target was captured on the IMAC resin.

Superdex 75 Size Exclusion Chromatography:

500 mM Imidazole Pool was considered pure enough to warrant size exclusion chromatography for final formulation. The 500 mM Imidazole IMAC pool was concentrated to <5.0 mL using a 110 kD MWCO Ultracel membrane (Millipore). The concentrate was injected over a 26/60 (318 mL) Superdex 75 SEC column (GE Healthcare) equilibrated in 35 mM NaPO4, 120 mM NaCl pH 7.2. at a flow rate of 3.0 mL/min while collecting 2.5 mL fractions throughout the isocratic elution. Conservative pooling was based on the inflection of A280 nm signal and SDS-PAGE analysis of collected fractions. The size exclusion pool was concentrated to 1 mg/mL using another 10 kD MWCO Ultracel membrane, 0.22 um filtered (Millipore), aliquotted, and stored at −80C.

Example 48

Expression of Human IL17RA Fc-Tagged Protein in CHO DXB11 Cells in a Wave Reactor IL17RA Fc5 (aka IL17R[FL]x1 C Fc5) protein was expressed in a 20 L Wavebag Reactor (Wave Biotech) in CHO DXB11 cells transfected with the ZG construct 1466. The cells were scaled up in shake flasks using ZF1 medium (JRH imMEDIAte Advantage Cat# 65633) with the addition of 5 mM L-glutamine (from 200 mM L-glutamine, Gibco catalog #25030-081), 1 mM sodium pyruvate (from 100 mM Sodium Pyruvate, Gibco catalog #11360-070) and 500 nM methotrexate. The reactor run was initiated by seeding one liter of shake flask culture in log phase into 9 L ZF1 medium containing L-glutamine and sodium pyruvate but no methotrexate. This resulted in a 10 L final working volume with a density of 1.7×10E5 c/mL.

The $CO_2$ level was maintained at 6% and was pumped continually into the headspace of the reactor at 0.1 LPM. Dissolved oxygen requirements of the cells were met by rocking the culture on a platform at a rate of 25 rocks per minute at an angle setting of 9.5. pH was not controlled but stayed between 6.6 and 7.0. Temperature was maintained at 37° C. until density reached approximately 1×10E6 cells/mL, then temperature was dropped to 34° C. for the remainder of the run. Glucose levels were maintained above 2 g/L and L-glutamine above 2 mM.

The culture was harvested 12 days after seeding with a density of 6.3×10E6 cells/mL and 98% viability. The supernatant was centrifuged at 3500×g for 15 minutes and the clarified conditioned medium was passed through a 0.22 µm filter (Millipore Opticap Cat# KW1904HB3) and submitted for protein purification.

Example 49

Purification of Human IL17R [FL][x1] C(Fc5) from CHO DXB11 5×SA Media

Poros Protein A 50 Affinty Column Capture—

Expression of Fc5 tagged target in delivered media was assessed via an analytical protein A-HPLC assay. Upon determining the expression levels, an appropriate volume of Poros A50 resin used to capture the expressed target, assuming a binding capacity of ~9 mg target per mL of packed bed. 10 L of delivered media were captured on 2×2 cm glass columns (Millipore), each column being 50 mL in bed volume. Each of the columns was packed with 50 mL Poros A50 resin (AB Biosystems) and had been equilibrated in the wash buffer indicated below. After the entire volume of media loaded over the resin, the columns were washed with 1.6 mM Citrate-monohydrate, 10.9 mM dibasic sodium phosphate, 0.25M Ammonium Sulfate, pH 6.0 until UV at A280 nm baseline stable. Bound protein was eluted from the resin via a 60 CV gradient from the above wash buffer to; 20 mM citrate-monohydrate, 5 mM dibasic sodium phosphate, 0.25M Ammonium Sulfate, pH 3.0 at 20 mL/min. Fractions were collected and neutralized using enough 2M Tris pH 8.0 to deliver a final pH of 7.0. The elution pool was analyzed via the above mentioned analytical protein A-HPLC assay.

Concentration of Protein A Affinity column Pool—

Initial concentration of protein A affinity pools was performed using 1×50 cm$^2$ 10 kD MWCO Biomax membrane (Millipore) set up in a Labscale TFF system (Millipore). Once the volume reached 120 mL, the concentrate was transferred to a stirred cell system (Millipore) with a 10 kD PES membrane (Millipore). Concentration was continued to a final volume of 20 mL. The stirred cell permeates were analyzed for Fc tagged target via the above mentioned analytical protein A—HPLC assay.

Superdex 200 Size Exclusion Chromatography—

2×10 mL volumes of the concentrated protein A affinity pool were injected over a 340 mL XK26 glass Superdex 200 SEC column (GE Healthcare) at a flow rate of 3.5 mL/min. The column was equilibrated in the following mobile phase; 35 mM NaPO4, 120 mM NaCl, pH 7.2. Fractions containing Fc tagged target were pooled, 0.22 um filtered (Millipore), aliquoted, and stored at −80 C.

Example 50

Preparation and Extraction of Insoluble IL17A from *Escherichia coli*

*E. coli* W3110 cells from a 2 L bioreactor fermentation containing the human IL17A were washed with 50 mM Tris pH 8 containing 200 mM NaCl and 5 mM EDTA to remove any broth contaminants. 1.2 L of ice cold lysis buffer (50 mM Tris pH 8, 200 mM NaCl, 5 mM EDTA, 5 mM Benzamidine and 5 mM DTT) was added to the 323g cell pellet and homogenized using the Polytron tissue-grinder until all clumps were disrupted. Next, the bacterial cells were lysed with three passes through a MicroFluidizer keeping the cell suspension chilled to 4° C. The final volume of the cell lysate was 1.73 L. The inclusion bodies in this lysate were pelleted by centrifuging 30 min at 20,000×g (12,000 rpm in a JA-14 rotor in a Beckman J2-21M centrifuge), 4° C. in eight 250-ml centrifuge bottles. The inclusion bodies were washed three times with lysis buffer to remove any *E. coli* unbroken cells and large cellular debris from the pelleted inclusion body protein. The supernatant was carefully poured off the pellet and the inclusion bodies were washed by suspending the pellet in lysis buffer and completely homogenizing to wash out soluble proteins and cellular components. The washed inclusion bodies were recovered by centrifuging 30 min at 15,000×g (12,000 rpm in JA-14), 4° C. Three of four washed pellets (38g each) were stored at −80° C. in 250 ml bottles and the fourth bottle was processed further. 7M Guanidine-HCl in 50 mM Tris pH 8 containing 100 mM sodium sulfite and 20 mM sodium tethrathionate was used to extract recombinant protein from washed pellets. Extraction with the denaturant dissociates protein-protein interactions and unfolds the protein. As a result, the extracted protein consists of unfolded monomers, with sulfhydryl groups in the reduced state and sulphonated. Using the tissue homogenizer, the 38g pellet was homogenized with 150 ml extraction buffer and clarified by centrifuging the suspension for two hours at 35,000×g at 4° C. The 178 ml clarified extract was evaluated by RP HPLC (23.3 mg/ml) and SDS PAGE (20.4 mg/ml) and divided into four parts. Three parts were stored at −80° C. until required. The fourth part was used for extract for preparing folded IL17A.

Refolding:

Ice cold refolding buffer (4 Liters) of the following composition was prepared; 0.75M Arginine, 55 mM MES (N-MorpholinoEthaneSulfonic acid), 10.56 mM NaCl, 0.44 mM KCl, 0.055% Peg 3.4 K (w/v), 1.1 mM EDTA, 440 mM Sucrose, 550 mM GuHCl, 1 mM GSH (reduced Glutithione), 1 mM GSSG (oxidized Glutithione), pH 6.5

The oxidation-reduction pair (GSH:GSSG) was added just prior to diluting the GuHCl solubilized, S-sulphonated inclusion body stock. The concentration of the Sulfytolized inclusion bodies was 20.4 mg/mL as determined by RP HPLC using suitable IL17F standard. 20 mL of the concentrated stock was added, dropwise, to 4 Liters of well stirred ice cold refolding buffer. Upon completing the dilution process, the atmosphere was flooded with Nitrogen and the vessel was tightly capped and placed in the cold room with gentle stirring. At various time intervals, samples were withdrawn for RP HPLC analysis. Each time a sample was taken, the vessel was flooded with Nitrogen gas and tightly capped, and replaced in the cold room with gentle stirring.

The observed HPLC dynamics at earliest points show multiple clustered peaks with earlier elution times than that of the starting material. Minimal peaks were observed downstream of the staring material elution time. Over time, a downfield peak began to increase at the expense of the upstream cluster of peaks. The cluster represents numerous partially Glutithyiolated moieties. The dimeric product peak advanced slowly over time at the expense of the up stream peak cluster.

Capture and Recovery on Cation Exchange (CIEX):

A cation exchange column (63 ml bed volume, 2 cm. Diameter) of SP Fast Flow (GE Healthcare) was equilibrated in Buffer A: 25 mM Acetic Acid, 100 mM NaCl, at pH 5.0. Two other buffers were utilized to run the CIEX process: Buffer B: 25 mM Acetic Acid; 2 Molar NaCl, pH 5.0 and Dilution Buffer: 100 mM Acetic acid, pH 4.7

The capture strategy utilizes in-line dilution proportioning at 20% refold Rxn to 80% Dilution Buffer to apply the load. The flow rate for the sample application phase of the chromatography was 10 ml/min. The column effluent conductivity is 20 milli-Siemens under the loading conditions. Reverse phase HPLC analysis; 500 ul injections of column pass through, indicated that all material(s) were binding under the loading parameters.

Following application of the entire refold reaction, the column was washed with Buffer A, for 20 column volumes until a steady UV absorbance baseline at 280 nm wavelength was obtained. Upon obtaining the steady baseline, the pump proportioning was set to 10% Buffer B and the column washed for 1 CV before eluting the bound protein with a 15 CV gradient from 10% buffer B (starting condition) to 100% B. A symmetric peak eluted fairly soon following initiation of the gradient. Fractions containing protein as indicated by the UV trace were analyzed by Reverse phase HPLC for target content. Analysis of the cation exchange protein pool demonstrated that a much higher proportion of dimeric product peak was present at this stage, with some of the cluster peaks still observable. Non-reducing SDS-PAGE analysis on protein containing fractions was employed to look at their complexity. The gels indicate a significant amount of monomeric and dimeric species, at a 1:1 ratio, are present at this stage.

Phenyl HP HIC Step:

The cation exchange pool is concentrated to 40 ml volume against a 10 kD cutoff membrane (Amicon Ultra-15) and adjusted to 0.7M $[NH_4]_2SO_4$ through slow addition of sufficient solid to the well stirred concentrate. Finally, the pH was adjusted to 7.5 with 2N NaOH in preparation for an Isocratic passage over a hydrophobic interaction column. A high performance Phenyl HP (Pharmacia) column (17 mL, 2 cm. dia.) was equilibrated in 0.7M Ammonium Sulfate; 20 mM $NaPO_4$, 20 mM MES, pH 7.5 buffer, at room temperature. The adjusted protein pool was applied to the column using a superloop injection port at a flow rate of 2.5 mL/min. Little protein passed during sample application at 2.5 ml min. Once the entire sample had been injected, the flow rate of equilibration buffer was increased to washout unbound protein. However, upon increasing the flow rate to 10 mL/min. for the wash phase, protein started to elute from the column. A fairly symmetric peak eluted with small plateau's on the leading and trailing flanks. A pool, excluding the leading and trailing plateau fractions was made and analyzed by RP HPLC. SDS-PAGE analysis (non-reducing) revealed that all of the higher MW multimers were cleared by this step, and that only monomer and dimeric species of IL17A remained, with the dimer being the predominant species.

Desalting Step:

The pooled protein from the hydrophobic chromatography step was concentrated to 10 mL against a 10 kD cutoff membrane (Amicon Ultra-15) and injected onto a Hi Trap 26/10 desalting column (Pharmacia) equilibrated in 35 mM $NaPO_4$ 109 mM NaCl, pH 7.0 buffer. Protein containing eluate fractions were analyzed by RP HPLC, sterile filtered, analyzed for protein content and tested for Endotoxin prior to being aliquoted and frozen at −80 degrees Example 51

Purification of Human IL17A $CH_6$ from 293F B Cells

Recombinant carboxyl terminal 6-Histidine tagged human IL17A protein was produced from transfected CHO cells expressing the target at approximately 0.3 mg/L. The CHO transfections were performed using methods known in the art. Approximately 7 L of conditioned media was harvested and sterile filtered using a 0.2 μm filter, concentrated to 1.0 L liters in a Millipore ProFlux M12 tangential flow filtration system equipped with two Pellicon 2 Mini 10K filters, then buffer exchanged with 10 volumes into PBS (0.137M NaCl, 0.0027 M KCl, 0.0072 $Na_2HPO_4$, 0.0015 M $KH_2PO_4$, pH 7.4.) Protein was purified from this buffer exchanged media by a combination of HisTrap HP Immobilized Metal Affinity Chromatography (IMAC, GE Healthcare, Piscataway, N.J.,) and Superdex 200 (GE Healthcare) Size Exclusion Chromatography (SEC.)

The 1.4 L buffer exchanged media was adjusted to 25 mM Imidazole and loaded overnight at 4° C., 1.2 ml/min (36 cm/hr) to a 5 ml (1.6×2.5 cm) HisTrap HP column pre-eluted with three CV 500 mM Imidazole and equilibrated with 20 CV 25 mM Imidazole, 50 mM Sodium Phosphate, 500 mM NaCl, 0.02% Azide pH 7.4. After loading, the column was washed with 20 CV equilibration buffer, then eluted in two steps for 10 CV at 5 ml/min (149 cm/hr) with 50 mM Imidazole, and 500 mM Imidazole, both in 50 mM Sodium Phosphate, 500 mM NaCl, 0.02% Azide pH 7.4. Eluted fractions were analyzed by SDS-PAGE, and those containing the target were pooled. Anti-His western analysis of pass-through indicated that all target bound.

Next the 9 ml IMAC pool was concentrated to 0.9 ml and injected to a 23 ml Superdex 200 (10 mm×300 mm) column equilibrated in 35 mM Phopshate, 120 mM NaCl, pH 7.3 and eluted at 0.4 ml/min (30 cm/hr.) Fractions were collected and pooled based on SDS-PAGE and A280, 0.2 μm filter sterilized and frozen as aliquots at −80° C. The concentration of the final purified protein was determined by BCA assay (Pierce, Rockford, Ill.). The overall process recovery was about 80%.

Analysis of Purified Human IL17A CH6

Recombinant Human IL17A CH6 was analyzed by SDS-PAGE (10% BisTris, Invitrogen, Carlsbad, Calif.) with 0.1% Coomassie R250 staining for protein and after transfer to nitrocellulose, by immunoblotting with Anti-His-HRP. The purified proteins were electrophoresed using an Invitrogen Novex's Xcell II mini-cell, and transferred to nitrocellulose (0.2 mm; Invitrogen, Carlsbad, Calif.) at ambient temperature at 600 mA for 45 minutes in a buffer containing 25 mM Tris base, 200 mM glycine, and 20% methanol. The filters were then blocked with 10% non-fat dry milk in 50 mM Tris, 150 mM NaCl, 5 mM EDTA, 0.05% Igepal (TBS) for 15 minutes at room temperature. The nitrocellulose was quickly rinsed, and the Anti-His-HRP antibody (1:2500) was added. The blots were incubated overnight at 4° C., with gentle shaking. Following the incubation, the blots were washed three times for 15 minutes each in TBS, and then quickly rinsed in $H_2O$. The blots were developed using commercially available chemiluminescent substrate reagents (Roche LumiLight), and the signal was captured using Lumi-Imager's Lumi Analyst 3.0 software (Boehringer Mannheim GmbH, Germany.)

The purified Human IL17A CH6 appeared as 2-3 bands on both the Western blot and the Coomassie stained gel under reducing and non-reducing conditions, suggesting glycosylated forms with the major band at about 39 kDa under non-reducing conditions. The protein had the correct amino acid composition and N-terminal sequencing yielded a strong single sequence having the correct NH2 terminus.

Example 52

Human IL-17F Protein Production from *E. coli*: A1275F Process

Preparation and Extraction of Insoluble IL17F from *Escherichia coli*:

*E. coli* W3110 cells from a 2 L bioreactor fermentation containing the human IL17F were washed with 50 mM Tris pH 8 containing 200 mM NaCl and 5 mM EDTA to remove any broth contaminants. 1.2 L of ice cold lysis buffer (50 mM Tris pH 8, 200 mM NaCl, 5 mM EDTA, 5 mM Benzamidine and 5 mM DTT) was added to the 350g cell pellet and homogenized using the Polytron tissue-grinder until all clumps were disrupted. Next, the bacterial cells were lysed with three passes through a MicroFluidizer keeping the cell suspension chilled to 4° C. The final volume of the cell lysate was 1.73 L. The inclusion bodies in this lysate were pelleted by centrifuging 30 min at 20,000×g (12,000 rpm in a JA-14 rotor in a Beckman J2-21M centrifuge), 4° C. in eight 250-ml centrifuge bottles. The inclusion bodies were washed three times with lysis buffer to remove any *E. coli* unbroken cells and large cellular debris from the pelleted inclusion body protein. The supernatant was carefully poured off the pellet and the inclusion bodies were washed by suspending the pellet in lysis buffer and completely homogenizing to wash out soluble proteins and cellular components. The washed inclusion bodies were recovered by centrifuging 30 min at 15,000×g (12,000 rpm in JA-14 rotor), 4° C. One half of the washed inclusion bodies (~64 grams wet weight) were stored at −80° C. in 250 ml bottles while the other half was processed further. 7M Guanidine-HCl in 50 mM Tris pH 8 containing 100 mM sodium sulfite and 20 mM sodium tethrathionate was used to extract recombinant protein from washed pellets. Extraction with the denaturant dissociates protein-protein interactions and unfolds the protein. As a result, the extracted protein consists of unfolded monomers, with sulfhydryl groups in the reduced state and sulphonated. Using the tissue homogenizer, the 64g pellet was homogenized with 100 ml extraction buffer and clarified by centrifuging the suspension for two hours at 35,000×g at 4° C. The 60 ml of clarified extract was evaluated by RP HPLC (28.4 mg/ml) and divided into four parts. Three parts were stored at −80° C. until required. The fourth part was used for preparing refolded IL17F.

Refolding:

Ice cold refolding buffer (4 Liters) of the following composition was prepared; 0.75M Arginine, 55 mM MES (N-MorpholinoEthaneSulfonic acid), 10.56 mM NaCl, 0.44 mM KCl, 0.055% Peg 3.4 K (w/v), 1.1 mM EDTA, 440 mM Sucrose, 550 mM GuHCl, 1 mM GSH (reduced Glutithione), 1 mM GSSG (oxidized Glutithione), pH 6.5

The oxidation-reduction pair (GSH:GSSG) was added just prior to diluting the GuHCL solubilized S-sulphonated inclusion body stock. The concentration of the Sulfytolized inclusion bodies was 28.4 mg/mL as determined by RP HPLC. 15 mL of the concentrated stock was added, dropwise, to 4 Liters of well stirred ice cold refolding buffer. Upon completing the dilution process, the vessel was tightly capped and placed in the cold room with gentle stirring. At various time intervals, samples were withdrawn for RP HPLC analysis. The vessel was gently stirred in the cold room for 72 hours before initiating recovery based on HPLC analysis.

UF/DF Process:

Following refolding, the refold mixture was put through a UF/DF process phase. The mixture was first concentrated, Vs 5K cutoff membrane, from 4 Liters down to approximately 475 mL. At this stage, the concentrate was left gently stirring in the cold room overnight. In the morning a DiaFiltration phase was initiated transitioning the retentate buffer composition with 900 mL throughput of 20 mM Tris; 120 mM NaCl @ pH 8.0 buffer. As diafiltration proceeded, at fixed vessel volume of 475 mL, clouding and flux rate reduction was apparent. The contents of the vessel were harvested at this point and centrifuged to remove the precipitate that had formed. RP HPLC analysis of the clarified solution indicated that no target had precipitated. The clarified mixture was diluted 1:1 (v/v) with 25 mM Acetic acid @ pH 5.4. The conductivity measured 9.8 milli-Siemens matching that which was needed for binding to a cation exchange column step. An additional 0.68 ml acetic acid was added, dropwise with simaltaneous titration (addition 2N NaOH) to keep pH at 5.4. Thus adjusted solution was filtered through a 1.2 micron filter and applied to the cation exchange column capture step.

Capture and Recovery on Cation Exchange (CIEX):

The adjusted solution from the UF/DF process was loaded at 20 mL/min to a 59 ml bed (2 cm dia.) of SP Fast Flow cation exchange media (Pharmacia) equilibrated in Buffer A: 25 mM Acetic acid; 100 mM NaCl @ (pH 5.4. After completing the sample load, the column was washed with 20 CV Buffer A until a steady baseline absorbance at 280 nm was attained. At that point, the product was eluted with a 20CV gradient formed between Buffer A and Buffer B: 20 mM acetic acid; 2M NaCl @ pH 5.4. The gradient starts at 100% Buffer A and at 20CV is completed at 25% BufferA:75% BufferB. The CIEX process was run at room temperature. The product eluted as a symmetric peak between 30-60 milli-Siemens conductivity. Fractions containing protein were analyzed by non-reducing SDS-PAGE coomassie staining and fractions with the dimeric IL17F were pooled and concentrated in preparation for size exclusion polishing and buffer exchange.

Size exclusion chromatography: The concentrated cation exchange pool (7 mL, containing 200 mg protein) was injected to a bed of Superdex 75 (26/60) size exclusion column (Pharmacia) equilibrated in 50 mM $NaPO_4$, 109 mM NaCl at pH 7.2 flowing at 3.5 ml/min. Eluted fractions containing mostly dimeric pure IL17F protein were pooled, sterile filtered, assayed for protein concentration and endotoxin levels before being aliquotted and stored at −80 degrees.

From the foregoing, it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (1027 sequences)

SEQ ID NO: 1 - DNA, 1874 bp, Homo sapiens
gaattccggcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaatgaactttaagtatgagaaaagttcagcccaagtaaaataaaaactcaatcacattcaattccagagtagtttcaagtttcacatcgtaaccattttcgcccggaattc

SEQ ID NO: 2 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 3 - DNA, 1025 bp, Homo sapiens
ccgaattcggcacgagaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtggcgcagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggct

SEQ ID NO: 4 - protein, 189 aa, Homo sapiens [sequence omitted]

SEQ ID NO: 5 - DNA, 1399 bp, Homo sapiens
ctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaat

SEQ ID NO: 6 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 7 - DNA, 3429 bp, Homo sapiens
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaa

SEQ ID NO: 8 - skipped

SEQ ID NO: 9 - DNA, 20 bp, Artficial Sequence
  primer
cgtaagcggtggcggttttc

SEQ ID NO: 10 - DNA, 20 bp, Artificial Sequence
  Primer
tgggcagggcacagtcacag

SEQ ID NO: 11 - DNA, 24 bp, Artificial Sequence
  Primer
atgaatcaggtcactattcaatgg

SEQ ID NO: 12 - DNA, 22 bp, Artificial Sequence
  Primer
ccagttcgggaatgatctgtta

SEQ ID NO: 13 - DNA, 24 bp, Artificial Sequence
  Primer
tatagaaggacacctagtcagaca

SEQ ID NO: 14 - DNA, 22 bp, Artificial Sequence
  Primer
tctatgtactgcactgctgaat

SEQ ID NO: 15 - DNA, 21 bp, Artificial Sequence
  Primer
cactggagtggcaacttccag

SEQ ID NO: 16 - DNA, 25 bp, Artificial Sequence
  Primer
caccagacataatagctgacagact

SEQ ID NO: 17 - DNA, 24 bp, Artificial Sequence
  Primer
ccaagttcagattgcaaggcagct

SEQ ID NO: 18 - DNA, 34 bp, Artificial Sequence
  Primer
ttactcgagacagctctacttttccaagagtgaa

SEQ ID NO: 19 - DNA, 30 bp, Artificial Sequence
  Primer
taaggatccgccaccatgaatcaggtcact

SEQ ID NO: 20 - DNA, 100 bp, Artificial Sequence
  Primer
gtaccttcccgtaaatccctccccttcccggaattacacccgcgtatttcccagaaaaggaactgtagatttctaggaattcaatccttggccacgcgtc

SEQ ID NO: 21 - DNA, 100 bp, Artificial Sequence
  Primer
tcgagacgcgtggccaaggattgaattcctagaaatctacagttccttttctgggaaatacgcgggtgtaattccgggaaggggagggatttacgggaag

SEQ ID NO: 22 - DNA, 1914 bp, Homo sapiens
ggatccgccaccatgaatcaggtcactattcaatgggatgcagtaatagccctttatatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtctcgag

SEQ ID NO: 23 - DNA, 1358 bp, Mus musculus
cgcttagaagtcggactacagagttagactcagaaccaaaggaggtggatagggggtccacaggcctggtgcagatcacagagccagccagatctgagaagcagggaacaagatgctggattgcagagcagtaataatgctatggctgttgccctgggtcactcagggcctggctgtgcctaggagtagcagtcctgactgggctcagtgccagcagctctctcggaatctctgcatgctagcctggaacgcacatgcaccagcgggacatatgaatctactaagagaagaagaggatgaagagactaaaaataatgtgccccgtatccagtgtgaagatggttgtgacccacaaggactcaaggacaacagccagttctgcttgcaaaggatccgccaaggtctggctttttataagcacctgcttgactctgacatcttcaaaggggagcctgctctactccctgatagccccatggagcaacttcacacctccctactaggactcagccaactcctccagccagaggatcacccccgggagacccaacagatgcccagcctgagttctagtcagcagtggcagcgcccccttctccgttccaagatccttcgaagcctccaggcctttttggccatagctgcccgggtctttgcccacggagcagcaactctgactgagcccttagtgccaacagcttaaggatgcccaggttcccatggctaccatgataagactaatctatcagcccagacatctaccagttaattaacccattaggacttgtgctgttcttgtttcgtttgttttgcgtgaagggcaaggacaccattattaaagagaaaagaaacaaaccccagagcaggcagctggctagagaaaggagctggagaagaagaataaagtctcgagcccttggccttggaagcgggcaagcagctgcgtggcctgaggggaagggggcggtggcatcgagaaactgtgagaaaacccagagcatcagaaaaagtgagcccaggctttggccattatctgtaagaaaaacaagaaaaggggaacattatactttcctgggtggctcagggaaatgtgcagatgcacagtactccagacagcagctctgtacctgcctgctctgtccctcagttctaacagaatctagtcactaagaactaacaggactaccaatacgaactgacaaatactaccactatgacctgtgacaaagctgcatatttattaagtgggaagggaacttttgatattatttatccttgtaacagtatagatgatggttatttattctatttataaggaattatgtatttttttttcaataaagatttatttatgtggc

SEQ ID NO: 24 - protein, 196 aa, Mus musculus
MLDCRAVIMLWLLPWVTQGLAVPRSSSPDWAQCQQLSRNLCMLAWNAHAPAGHMNLLREEEDEETKNNVPRIQCEDGCDPQGLKDNSQFCLQRIRQGLAFYKHLLDSDIFKGEPALLPDSPMEQLHTSLLGLSQLLQPEDHPRETQQMPSLSSSQQWQRPLLRSKILRSLQAFLAIAARVFAHGAATLTEPLVPTA

SEQ ID NO: 25 - DNA, 1840 bp, Mus musculus
gcacatcagaccaggcagctcgcagcaaagcaagatgtgtcctcagaagctaaccatctcctggtttgccatcgttttgctggtgtctccactcatggccatgtgggagctggagaaagacgtttatgttgtagaggtggactggactcccgatgcccctggagaaacagtgaacctcacctgtgacacgcctgaagaagatgacatcacctggacctcagaccagagacatggagtcataggctctggaaagaccctgaccatcactgtcaaagagtttctagatgctggccagtacacctgccacaaaggaggcgagactctgagccactcacatctgctgctccacaagaaggaaaatggaatttggtccactgaaattttaaaaaatttcaaaaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgatcctaggatgcaacgttggaaaggaaagaaaagtggaagacattaaggaagaaaaatttaaactcaggatggaagagtcccccaaaagctgtcttctgcttggttggctttttccagttttcctaagttcatcatgacacctttgctgatttctacatgtaaatgttaaatgcccgcagagccagggagctaatgtatgcatagatattctagcattccacttggccttatgctgttgaaatatttaagtaatttatgtatttattaatttatttctgcatttcacatttgtataccaagatgtattgaatatttcatgtgctcgtggcctgatccactgggaccaggccctattatgcaaattgtgagcttgttatcttcttcaacagctcttcaatcagggctgcgtaggtacattagcttttgtgacaaccaataagaacataatattctgacacaagcagtgttacatatttgtgaccagtaaagacataggtggtatttggagacatgaagaagctgtaaagttgactctgaagagtttagcactagtttcaacaccaagaaagactttttagaagtgatattgataagaaaccagggccttctttagaagggtacctaaatttaaaagaattttgaaaggctgggtatcggtggtatatgcttttaattccagcactcaggagaccaaggcaggcagatctctgtgagtttgaggacagcctggtgtacagagggagttccagcacagccagtgccacacagaaattctgtctcaaaaacaattaaaaaaaaaaaaaa

SEQ ID NO: 26 - protein, 335 aa, Mus musculus
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 27 - DNA, 25 bp, Artificial Sequence
  Oligo primer ZC 56837
atgactcctgggaagacctcattgg

SEQ ID NO: 28 - DNA, 25 bp, Artificial Sequence
  Oligo primer ZC56838
ttaggctacatggtggacaatgggg

SEQ ID NO: 29 - DNA, 468 bp, Macaca fascicularis
atgactcctgggaagacctcattggtgctactgctgctgctgctgagcctggaggccatagtgaaggcaggaatagcaatcccacgaaattcaggatgcccaaattctgaggacaagaacttcccccggactgtgatggtcaacctgaacatccataaccggaataccagtaccaatcccaaaaggtcctcagattactacaaccgatccacctcaccttggaatctccaccgcaatgaggaccctgagagatatccctctgtgatctgggaggcaaaatgccgccacttaggctgcgtcaaggctgatgggaacgtagactaccacatgaactctgtccccatccagcaagagatcctggtcctgcgcagggagcctcggcactgccccaactccttccggctggagaagatactggtgtccgtgggctgcacctgtgtcacccccattgtccaccatgtagcctaa

SEQ ID NO: 30 - DNA, 604 bp, Macaca fascicularis
gccaccatgctggggagcagagctgtaatgctgctgttgctgctgtcctggacagctcagggcagggctgtgcctgggggcagcagccctgcctgggctcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggattcgccagggtctgattttttacgagaagctactgggatcggatattttcacaggggagccttctctgctgcctgatagccctgtgggccagcttcatgcctccctactgggcctcagccaactcctgcagcctgagggtcaccactgggagactcagcagattccaagccccagtcccagccagccatggcagcgcctccttctccgcttcaaaatccttcgcagcctccaggcctttgtggctgtagctgcccgggtctttgcccatggagcagcaaccctgagcccctaaagccagcagctcaaggatggcactcaga

SEQ ID NO: 31 - protein, 11 aa, Homo sapiens
RASQDITNYLA

SEQ ID NO: 32 - protein, 7 aa, homo sapiens
SASNLQS

SEQ ID NO: 33 - protein, 9 aa, Homo sapiens
  VARIANT (8)...(8): Xaa is Lys or Ile
QQYESYPXT

SEQ ID NO: 34 - protein, 5 aa, Homo sapiens
  VARIANT (1)...(1): Xaa is Ala or Glu
  VARIANT (3)...(3): Xaa is Val or Asn
  VARIANT (5)...(5): Xaa is Asp or Asn
XYXMX

SEQ ID NO: 35 - protein, 17 aa, Homo sapiens
  VARIANT (1)...(1): Xaa is Ser or Trp
  VARIANT (4)...(4): Xaa is Ser or Pro
  VARIANT (10)...(10): Xaa is Pro or Asp
XIGXSGGQTXYADSVKG

SEQ ID NO: 36 - protein, 10 aa, Homo sapiens
NEGLVGAFDI

SEQ ID NO: 37 - protein, 16 aa, Homo sapiens
DFLEWLLLTTNYGMDV

SEQ ID NO: 38 - protein, 11 aa, Homo sapiens
RASQSISDWVA

SEQ ID NO: 39 - protein, 7 aa, Homo sapiens
KASILES

SEQ ID NO: 40 - protein, 9 aa, Homo sapiens
  VARIANT (4)...(4): Xaa is Asp or Glu
  VARIANT (7)...(7): Xaa is Ser or Pro
  VARIANT (8)...(8): Xaa is Trp or Leu
QQYXSYXXT

SEQ ID NO: 41 - protein, 5 aa, Homo sapiens
LYKMF

SEQ ID NO: 42 - protein, 17 aa, Homo sapiens
RISSSGGGTKYADSVKG

SEQ ID NO: 43 - protein, 14 aa, Homo sapiens
SYSSGWYWGGAFDI

SEQ ID NO: 44 - protein, 11 aa, Homo sapiens
  VARIANT (5)...(5): Xaa is Ser or Asn
  VARIANT (7)...(7): Xaa is Ser, Gly, or Asn
  VARIANT (8)...(8): Xaa is Thr or Ser
  VARIANT (10)...(10): Xaa is Val or Leu
RASQXIXXYXN

SEQ ID NO: 45 - protein, 7 aa, Homo sapiens
  VARIANT (1)...(1): Xaa is Gly or Ala
  VARIANT (4)...(4): Xaa is Thr or Ser
  VARIANT (6)...(6): Xaa is HIs or Gln
XASXLXS

SEQ ID NO: 46 - protein, 9 aa, Homo sapiens
  VARIANT (5)...(5): Xaa is Thr, Ser, Asn
  VARIANT (6)...(6): Xaa is Thr or Tyr
  VARIANT (8)...(8): Xaa is Phe or Arg
QQSYXXPXT

SEQ ID NO: 47 - protein, 5 aa, Homo sapiens
  VARIANT (1)...(1): Xaa is Leu, Glu, Asp, Pro or Phe
  VARIANT (3)...(3): Xaa is Arg, Asn, Gly or Ser
  VARIANT (5)...(5): Xaa is Arg, Asn, Gly or Gln
XYXMX

SEQ ID NO: 48 - protein, 18 aa, Homo sapiens
  VARIANT (1)...(1): Xaa is Ser of Trp
  VARIANT (3)...(3): Xaa is Gly, Ser, or Val
  VARIANT (4)...(4): Xaa is Pro or Ser
  VARIANT (8)...(8): Xaa is His or no amino acid
  VARIANT (9)...(9): Xaa is Glu, Gln, Thr, Lys, or Phe
  VARIANT (11)...(11): Xaa is Met, Asp, or Lys
  VARIANT (16)...(16): Xaa is  Val or Iso
XIXXSGGXXTXYADSXKG

SEQ ID NO: 49 - protein, 16 aa, Homo sapiens
DFLEWLLLTTNYGMDV

SEQ ID NO: 50 - protein, 16 aa, Homo sapiens
DFLEWLLLTSNYGMDV

SEQ ID NO: 51 - protein, 11 aa, Homo sapiens
  VARIANT (7)...(7): Xaa is Ser or Gly
  VARIANT (8)...(8): Xaa is Asn or Thr
  VARIANT (9)...(9): Xaa is Phe or Tyr
QASQDIXXXLN

SEQ ID NO: 52 - protein, 7 aa, Homo sapiens
  VARIANT (2)...(2): Xaa is Ser or Ala
  VARIANT (4)...(4): Xaa is Ser or Asn
  VARIANT (6)...(6): Xaa is Gly or Glu
  VARIANT (7)...(7): Xaa is Ala or Thr
DXSXLXX

SEQ ID NO: 53 - protein, 9 aa, Homo sapiens
  VARIANT (3)...(3): Xaa is Tyr or Ser
  VARIANT (4)...(4): Xaa is Glu, Asn, Asp, or Tyr
  VARIANT (5)...(5): Xaa is Thr, Ser, Tyr, or Asp
  VARIANT (6)...(6): Xaa is Phe, Tyr, Leu, or Thr
  VARIANT (8)...(8): Xaa is Tyr, Trp, Ile or Leu
QQXXXXPXT

SEQ ID NO: 54 - protein, 5 aa, Homo sapiens
  VARIANT (1)...(1): Xaa is Iso, Phe, Ala, Leu, or Pro
  VARIANT (3)...(3): Xaa is Asp, Pro, Gln, Lys, or Met
  VARIANT (5)...(5): Xaa is Val, Tyr, Gly, or Phe
XYXMX

SEQ ID NO: 55 - protein, 17 aa, Homo sapiens
  VARIANT (1)...(1): Xaa is Tyr, Ser, Arg, or Gly
  VARIANT (3)...(3): Xaa is Trp, Ser or Tyr
  VARIANT (4)...(4): Xaa is Sre or Pro
  VARIANT (7)...(7): Xaa is Gly or Asp
  VARIANT (8)...(8): Xaa is Met, Ser, Ala, or Gly
  VARIANT (10)...(10): Xaa is Met, Ile, Lys, or Tyr
XIXXSGXXTXYADSVKG

SEQ ID NO: 56 - protein, 15 aa, Homo sapiens
ESVARWLQSGAAFDI

SEQ ID NO: 57 - protein, 8 aa, Homo sapiens
VSGFGELW

SEQ ID NO: 58 - protein, 14 aa, Homo sapiens
SYSSGWYWGGAFDI

SEQ ID NO: 59 - protein, 13 aa, Homo sapiens
HYYDSSGYLSFDY

SEQ ID NO: 60 - protein, 15 aa, Homo sapiens
EYYDFWSGYYYYMDV

SEQ ID NO: 61 - protein, 5 aa, Homo sapiens
GILDY

SEQ ID NO: 62 - protein, 13 aa, Homo sapiens
  VARIANT (3)...(3): Xaa is Ser or Gly
  VARIANT (9)...(9): Xaa is Ser or Leu
  VARIANT (11)...(11): Xaa is Thr or Pro
SGXSSNIGXNXVN

SEQ ID NO: 63 - protein, 7 aa, Homo sapiens
  VARIANT (1)...(1): Xaa is Ser of Asn
  VARIANT (2)...(2): Xaa is Asn or Asp
XXNQRPS

SEQ ID NO: 64 - protein, 11 aa, Homo sapiens
  VARIANT (2)...(2): Xaa is Val or Ala
  VARIANT (10)...(10): Xaa is Trp or Val
AXWDDSLNGXV

SEQ ID NO: 65 - protein, 5 aa, Homo sapiens
LYDML

SEQ ID NO: 66 - protein, 17 aa, Homo sapiens
SISSSGGVTMYADSVKG

SEQ ID NO: 67 - protein, 20 aa, Homo sapiens
DPGNYYDSSGYGWLGPGVNL

SEQ ID NO: 68 - protein, 11 aa, Homo sapiens
  VARIANT (4)...(4): Xaa is Ala, Asn, or Lys
  VARIANT (7)...(7): Xaa is Gln, His, or Asp
SGDXLGXKYAS

SEQ ID NO: 69 - protein, 7 aa, Homo sapiens
  VARIANT (1)...(1): Xaa is Gln or Glu
  VARIANT (3)...(3): Xaa is Ser or Thr
XDXKRPS

SEQ ID NO: 70 - protein, 10 aa, Homo sapiens
  VARIANT (2)...(2): Xaa is Thr, Ser, or Ala
  VARIANT (7)...(7): Xaa is Thr or Ser
  VARIANT (8)...(8): Xaa is Arg or no amino acid
  VARIANT (9)...(9): Xaa is Ala, Val or Tyr
  VARIANT (10)...(10): Xaa is Val or Ile
QXWDSSXXXX

SEQ ID NO: 71 - protein, 5 aa, Homo sapiens
  VARIANT (1)...(1): Xaa is Ala, Phe, Arg, Leu, or Pro
  VARIANT (3)...(3): Xaa is Gln, Asn, Ile, Arg Lys, or Met
  VARIANT (5)...(5): Xaa is Gly, Ser, Asn, Val, Asp, or Phe
XYXMX

SEQ ID NO: 72 - protein, 17 aa, Homo sapiens
  VARIANT (1)...(1): Xaa is Ser, Val, Arg, or Gly
  VARIANT (3)...(3): Xaa is Ser, Val or Tyr
  VARIANT (4)...(4): Xaa is Pro or Ser
  VARIANT (8)...(8): Xaa is Ala, Phe, Asn, or Gly
  VARIANT (10)...(10): Xaa is Lys, Asp, Met, His, or Tyr
XIXXSGGXTXYADSVKG

SEQ ID NO: 73 - protein, 13 aa, Homo sapiens
HYYDSSGYLSFDY

SEQ ID NO: 74 - protein, 13 aa, Homo sapiens
HYYDSSGYSSFDY

SEQ ID NO: 75 - protein, 14 aa, Homo sapiens
SYSSGWYWGGAFDI

SEQ ID NO: 76 - protein, 18 aa, Homo sapiens
VGSSIAARRPSYYYGMDV

SEQ ID NO: 77 - protein, 14 aa, Homo sapiens
SYDSSGYYPGYFQN

SEQ ID NO: 78 - DNA, 319 bp, Homo sapiens
cagagcgctttgactcagtcaccctcattgtccgtgtccccaggacagacagccaccatcacatgctctggagataacttgggacataaatatgcttcttggtatcagcagaggccaggccagtcccctgtcttggtcatctatgaagattccaagcggccctcagggatccctgagcgattctctggctccaactccgggaacacagccactctgaccatcagcgagacccaggctgtggatgaggctgactattactgtcagtcgtgggacagcagcaccgtgatattcggcggagggaccaagctgaccgtcctac

SEQ ID NO: 79 - DNA, 382 bp, Homo sapiens
gaagttcaattgttagagtctggtggcggtcttgttcagcctggtggttctttacgtctttcttgcgctgcttccggattcactttctctcgttacattatggtttgggttcgccaagctcctggtaaaggtttggagtgggtttcttctatctctccttctggtggcgctactatgtatgctgactccgttaaaggtcgcttcactatctctagagacaactctaagaatactctctacttgcagatgaacagcttaagggctgaggacacggccgtgtattactgtgcaacagttgggtcgagtatagcagctcgtcgcccctcctactactacggtatggacgtctggggccaagggaccacggtcaccgtctcaagcg

SEQ ID NO: 80 - protein, 106 aa, Homo sapiens
QSALTQSPSLSVSPGQTATITCSGDNLGHKYASWYQQRPGQSPVLVIYEDSKRPSGIPERFSGSNSGNTATLTISETQAVDEADYYCQSWDSSTVIFGGGTKLTVL

SEQ ID NO: 81 - protein, 127 aa, Homo sapiens
EVQLLESGGGLVQPGGSLRLSCAASGFTFSRYIMVWVRQAPGKGLEWVSSISPSGGATMYADSVKGRFTISRDNSKNTLYLQMNSLRAEDTAVYYCATVGSSIAARRPSYYYGMDVWGQGTTVTVSS

SEQ ID NO: 82 - DNA, 331 bp, Homo sapiens
cagagcgctttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccggttctctggctccaagtctggcacctcagcccccctggccatcagtgggctccagtctgaggatgaggctgattattactgtgcagtatgggatgacagcctgaatggttgggtgttcggcggagggaccaagctgaccgtcctag

SEQ ID NO: 83 - DNA, 388 bp, Homo sapiens
gaagttcaattgttagagtctggtggcggtcttgttcagcctggtggttctttacgtctttcttgcgctgcttccggattcactttctctctttacgatatgctttgggttcgccaagctcctggtaaaggtttggagtgggtttcttctatctcttcttctggtggcgttactatgtatgctgactccgttaaaggtcgcttcactatctctagagacaactctaagaatactctctacttgcagatgaacagcttaagggctgaggacacagccgtgtattactgtaccacagatccgggaaattactatgatagtagtggttatggatggttggggccaggggtcaatctgtggggccagggaaccctggtcaccgtctcaagcg

SEQ ID NO: 84 - protein, 110 aa, Homo sapiens
QSALTQPPSASGTPGQRVTISCSGSSSNIGSNTVNWYQQLPGTAPKLLIYSNNQRPSGVPDRFSGSKSGTSAPLAISGLQSEDEADYYCAVWDDSLNGWVFGGGTKLTVL

SEQ ID NO: 85 - protein, 129 aa, Homo sapiens
EVQLLESGGGLVQPGGSLRLSCAASGFTFSLYDMLWVRQAPGKGLEWVSSISSSGGVTMYADSVKGRFTISRDNSKNTLYLQMNSLRAEDTAVYYCTTDPGNYYDSSGYGWLGPGVNLWGQGTLVTVSS

SEQ ID NO: 86 - DNA, 322 bp, Homo sapiens
gacatccagatgacccagtctccatcttccctgtctgcatctgtcggagacagagtcaccatcacttgccgggcaagtcagagcattagcacctatgtaaattggtatcagtcgaaaccagggaaagcccctagactcctgatatatggtgcgtccactttgcacagtggggtcccatcaaggttcagtggcactggatctgggacagatttcactctcaccgtcagcagtctgcaacctgaagatttcgcagcataccactgtcaacagagttacactaccccgttcactttcggcggagggaccacggtggacatcaaac

SEQ ID NO: 87 - DNA, 379 bp, Homo sapiens
gaagttcaattgttagagtctggtggcggtcttgttcagcctggtggttctttacgtctttcttgcgctgcttccggattcactttctctctttaccgtatgcgttgggttcgccaagctcctggtaaaggtttggagtgggtttcttctatcggtccttctggtggccatgagactatgtatgctgactccgttaaaggtcgcttcactatctctagagacaactctaagaatactctctacttgcagatgaacagcttaagggctgaggacacggccgtgtattactgtgcgagagatttcttggagtggttattactgacaaccaactacggtatggacgtctggggccaagggaccacggtcaccgtctcaagcg

SEQ ID NO: 88 - protein, 107 aa, Homo sapiens
DIQMTQSPSSLSASVGDRVTITCRASQSISTYVNWYQSKPGKAPRLLIYGASTLHSGVPSRFSGTGSGTDFTLTVSSLQPEDFAAYHCQQSYTTPFTFGGGTTVDIK

SEQ ID NO: 89 - protein, 126 aa, Homo sapiens
EVQLLESGGGLVQPGGSLRLSCAASGFTFSLYRMRWVRQAPGKGLEWVSSIGPSGGHETMYADSVKGRFTISRDNSKNTLYLQMNSLRAEDTAVYYCARDFLEWLLLTTNYGMDVWGQGTTVTVSS

SEQ ID NO: 90 - DNA, 322 bp, Homo sapiens
gacatccagatgacccagtctccatcctccctgtctgcatctgcaggagacagagtcaccatcacttgccaggcgagtcaggacattagcaactttttaaattggtatcaacagaaaccagggaaagcccctaagctcctgatctacgattcatctagtttgggagcaggggtcccatcaaggttcagtggaactggatctgtgacagattttactttcaccatcagcaacctgcagcccgaagatgttgcaacttattactgtcaacagtatgagactttcccgtacacttttggccaggggaccaagctggagatcaaac

SEQ ID NO: 91 - DNA, 373 bp, Homo sapiens
gaagttcaattgttagagtctggtggcggtcttgttcagcctggtggttctttacgtctttcttgcgctgcttccggattcactttctctatttacgatatggtttgggttcgccaagctcctggtaaaggtttggagtgggtttcttatatctggtcttctggtggcatgactatgtatgctgactccgttaaaggtcgcttcactatctctagagacaactctaagaatactctctacttgcagatgaacagcttaagggctgaggacacagccacatattactgtgcgagagagtattacgatttttggagtggttactactactacatggacgtctggggcaaagggaccacggtcaccgtctcaagcg

SEQ ID NO: 92 - protein, 107 aa, Homo sapiens
DIQMTQSPSSLSASAGDRVTITCQASQDISNFLNWYQQKPGKAPKLLIYDSSSLGAGVPSRFSGTGSVTDFTFTISNLQPEDVATYYCQQYETFPYTFGQGTKLEIK

SEQ ID NO: 93 - protein, 124 aa, Homo sapiens
EVQLLESGGGLVQPGGSLRLSCAASGFTFSIYDMVWVRQAPGKGLEWVSYIWSSGGMTMYADSVKGRFTISRDNSKNTLYLQMNSLRAEDTATYYCAREYYDFWSGYYYYMDVWGKGTTVTVSS

SEQ ID NO: 94 - DNA, 322 bp, Homo sapiens
gacatccagatgacccagtctccatcttcgctgtctgcatctgttggagacagagtcaccatcacttgtcgggcgagtcaggacattaccaattatttagcctggtttcagcagtcacctgggaaagcccctaagtccctgatctattctgcatccaatttacaaagtggggtcccatcaaagttcagcggcagtggatctgggacagatttcactctcaccatcaacaacctgcagccggaagattttgcaacttattactgccaacagtatgaaagttaccccctcaccttcggccaagggacacgactggagcttagac

SEQ ID NO: 95 - DNA, 358 bp, Homo sapiens
gaagttcaattgttagagtctggtggcggtcttgttcagcctggtggttctttacgtctttcttgcgctgcttccggattcactttctctgcttacgttatggattgggttcgccaagctcctggtaaaggtttggagtgggtttcttctatcggttcttctggtggccagactccttatgctgactccgttaaaggtcgcttcactatctctagagacaactctaagaatactctctacttgcagatgaacagcttaagggctgaggacacggccgtgtattactgtgcgagaaacgaaggactggtgggagcttttgatatctggggccaagggacaatggtcaccgtctcaagcg

SEQ ID NO: 96 - protein, 107 aa, Homo sapiens
DIQMTQSPSSLSASVGDRVTITCRASQDITNYLAWFQQSPGKAPKSLIYSASNLQSGVPSKFSGSGSGTDFTLTINNLQPEDFATYYCQQYESYPLTFGQGTRLELR

SEQ ID NO: 97 - protein, 119 aa, Homo sapiens
EVQLLESGGGLVQPGGSLRLSCAASGFTFSAYVMDWVRQAPGKGLEWVSSIGSSGGQTPYADSVKGRFTISRDNSKNTLYLQMNSLRAEDTAVYYCARNEGLVGAFDIWGQGTMVTVSS

SEQ ID NO: 98 - DNA, 322 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctaggacgttcggccaagggaccaaggtggaaatcaaac

SEQ ID NO: 99 - DNA, 376 bp, Homo sapiens
gaagttcaattgttagagtctggtggcggtcttgttcagcctggtggttctttacgtctttcttgcgctgcttccggattcactttctctgagtacaatatgaattgggttcgccaagctcctggtaaaggtttggagtgggtttcttggatcggtccttctggtggccagactgattatgctgactccgttaaaggtcgcttcactatctctagagacaactctaagaatactctctacttgcagatgaacagcttaagggctgaggacacggccgtgtattactgtgcgagagatttcttggagtggttattactgacaaccaactacggtatggacgtctggggccaagggaccacggtcaccgtctcaagcg

SEQ ID NO: 100 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 101 - protein, 125 aa, Homo sapiens
EVQLLESGGGLVQPGGSLRLSCAASGFTFSEYNMNWVRQAPGKGLEWVSWIGPSGGQTDYADSVKGRFTISRDNSKNTLYLQMNSLRAEDTAVYYCARDFLEWLLLTTNYGMDVWGQGTTVTVSS

SEQ ID NO: 102 - DNA, 319 bp, Homo sapiens
cagagcgctttgactcagccaccctcagtgtccgtgtccccaggacagacagccaccatcacctgctctggagataaattgggggataaatatgcttcctggtatcagcagaagccaggccagtcccctgtgctggtcatctatcaagataccaagcggccctcagggatccctgagcgattctctggctccaactctgggagcacagccactctgaccatcagcgggacccaggctatggatgaggctgactattactgtcaggcgtgggacagcagttcttatgtcttcggaactgggaccagggtcaccgtcctag

SEQ ID NO: 103 - DNA, 370 bp, Homo sapiens
gaagttcaattgttagagtctggtggcggtcttgttcagcctggtggttctttacgtctttcttgcgctgcttccggattcactttctctcgttaccgtatggattgggttcgccaagctcctggtaaaggtttggagtgggtttctgttatcgttccttctggtggcaatactcattatgctgactccgttaaaggtcgcttcactatctctagagacaactctaagaatactctctacttgcagatgaacagcttaagggctgaggacacagccgtgtattactgtaccagttcctatgacagtagtggttattaccctgggtacttccagaactggggccagggcaccctggtaaccgtctcaagcg

SEQ ID NO: 104 - protein, 106 aa, Homo sapiens
QSALTQPPSVSVSPGQTATITCSGDKLGDKYASWYQQKPGQSPVLVIYQDTKRPSGIPERFSGSNSGSTATLTISGTQAMDEADYYCQAWDSSSYVFGTGTRVTVL

SEQ ID NO: 105 - protein, 123 aa, Homo sapiens
EVQLLESGGGLVQPGGSLRLSCAASGFTFSRYRMDWVRQAPGKGLEWVSVIVPSGGNTHYADSVKGRFTISRDNSKNTLYLQMNSLRAEDTAVYYCTSSYDSSGYYPGYFQNWGQGTLVTVSS

SEQ ID NO: 106 - DNA, 322 bp, Homo sapiens
gacatccagatgacccagtctccatcctccctgtctgcatctgttagagacagagtcacgttcacttgccgggcaagtcagagcattggcagctacttaaattggtatcagcagaaaccagggaaagcccctagcctcctgatctatgctgcctccagtttgcaaagtggggtcccatcaaggttcagtggcagtgggtctgggacagatttcactctcaccatcagcagtctgcaacctgaagattttgcaacttactactgtcaacagagttacagttaccctaggacgttcggcccagggaccaaggtggagatcaaac

SEQ ID NO: 107 - DNA, 376 bp, Homo sapiens
gaagttcaattgttagagtctggtggcggtcttgttcagcctggtggttctttacgtctttcttgcgctgcttccggattcactttctctgattacggtatgggttgggttcgccaagctcctggtaaaggtttggagtgggtttcttctatctctccttctggtggcactactgattatgctgactccattaaaggtcgcttcactatctctagagacaactctaagaatactctctacttgcagatgaacagcttaagggctgaggacacagccgtgtattactgtacgagagatttcttggagtggttattactgacaaccaactacggtatggacgtctggggccaagggaccacggtcaccgtctcaagcg

SEQ ID NO: 108 - protein, 107 aa, Homo sapiens
DIQMTQSPSSLSASVRDRVTFTCRASQSIGSYLNWYQQKPGKAPSLLIYAASSLQSGVPSRFSGSGSGTDFTLTISSLQPEDFATYYCQQSYSYPRTFGPGTKVEIK

SEQ ID NO: 109 - protein, 125 aa, Homo sapiens
EVQLLESGGGLVQPGGSLRLSCAASGFTFSDYGMGWVRQAPGKGLEWVSSISPSGGTTDYADSIKGRFTISRDNSKNTLYLQMNSLRAEDTAVYYCTRDFLEWLLLTTNYGMDVWGQGTTVTVSS

SEQ ID NO: 110 - DNA, 322 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgatgattttgcaacttattactgccaacagtataatagttatccttggacgttcggccaggggaccaaggtggaaatgaaac

SEQ ID NO: 111 - DNA, 343 bp, Homo sapiens
gaagttcaattgttagagtctggtggcggtcttgttcagcctggtggttctttacgtctttcttgcgctgcttccggattcactttctctttttacgatatggtttgggttcgccaagctcctggtaaaggtttggagtgggtttcttctatctggtcttctggtggctctactatgtatgctgactccgttaaaggtcgcttcactatctctagagacaactctaagaatactctctacttgcagatgaacagcttaagggctgaggacacggccgtgtattactgtgcggtgggtattcttgactactggggccagggaaccctggtcaccgtctcaagcg

SEQ ID NO: 112 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPDDFATYYCQQYNSYPWTFGQGTKVEMK

SEQ ID NO: 113 - protein, 114 aa, Homo sapiens
EVQLLESGGGLVQPGGSLRLSCAASGFTFSFYDMVWVRQAPGKGLEWVSSIWSSGGSTMYADSVKGRFTISRDNSKNTLYLQMNSLRAEDTAVYYCAVGILDYWGQGTLVTVSS

SEQ ID NO: 114 - DNA, 322 bp, Homo sapiens
gacatccagatgacccagtctccatcctccgtgtctgcagctgtaggaggcagagtcaccatcacttgtcgggcgagtcaggatattagcagctggttagcctggtatcagcagaaaccagggaaagcccctaaactcctgatctatggtgcatccagtttccaaaatggggacccatcaaggttcagcggcagtggatctgggacagaattcactctcaccatcagcagcctgcagcccgaagattctgcaacttactattgtcaacaggctagcagtttccctcagacttttggccaggggaccaaggtggagatcaaac

SEQ ID NO: 115 - DNA, 355 bp, Homo sapiens
gaagttcaattgttagagtctggtggcggtcttgttcagcctggtggttctttacgtctttcttgcgctgcttccggattcactttctctgcttacggtatgtattgggttcgccaagctcctggtaaaggtttggagtgggtttcttatatcggtccttctggtggccttactatttatgctgactccgttaaaggtcgcttcactatctctagagacaactctaagaatactctctacttgcagatgaacagcttaagggctgaggacactgcagtctactattgtgcgagagatttctttacgtcctactttgactactggggccagggaaccctggtcaccgtctcaagcg

SEQ ID NO: 116 - protein, 107 aa, Homo sapiens
DIQMTQSPSSVSAAVGGRVTITCRASQDISSWLAWYQQKPGKAPKLLIYGASSFQNGDPSRFSGSGSGTEFTLTISSLQPEDSATYYCQQASSFPQTFGQGTKVEIK

SEQ ID NO: 117 - protein, 118 aa, Homo sapiens
EVQLLESGGGLVQPGGSLRLSCAASGFTFSAYGMYWVRQAPGKGLEWVSYIGPSGGLTIYADSVKGRFTISRDNSKNTLYLQMNSLRAEDTAVYYCARDFFTSYFDYWGQGTLVTVSS

SEQ ID NO: 118 - DNA, 340 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaaggtatacaccttcccccgatcaccttcggccaggggacacgactggagattaaac

SEQ ID NO: 119 - DNA, 349 bp, Homo sapiens
gaagttcaattgttagagtctggtggcggtcttgttcagcctggtggttctttacgtctttcttgcgctgcttccggattcactttctctttttactatatgggttgggttcgccaagctcctggtaaaggtttggagtgggtttctcgtatctctccttctggtggcattactccttatgctgactccgttaaaggtcgcttcactatctctagagacaactctaagaatactctctacttgcagatgaacagcttaagggctgaggacacggccgtgtattactgtgcgagagatgtgggtgcttttgatatctggggccaagggacaatggtcaccgtctcaagcg

SEQ ID NO: 120 - protein, 113 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQGIHLPPITFGQGTRLEIK

SEQ ID NO: 121 - protein, 116 aa, Homo sapiens
EVQLLESGGGLVQPGGSLRLSCAASGFTFSFYYMGWVRQAPGKGLEWVSRISPSGGITPYADSVKGRFTISRDNSKNTLYLQMNSLRAEDTAVYYCARDVGAFDIWGQGTMVTVSS

SEQ ID NO: 122 - DNA, 322 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcgctctcaccatcaccagtctgcaacctgaagattttgcaacttacttctgtcaacagagttacaatacccctcggacgtttggccaagggaccaaggtggagatcaaac

SEQ ID NO: 123 - DNA, 376 bp, Homo sapiens
gaagttcaattgttagagtctggtggcggtcttgttcagcctggtggttctttacgtctttcttgcgctgcttccggattcactttctctccttactctatgcagtgggttcgccaagctcctggtaaaggtttggagtgggtttcttctatcggttcttctggtggcaagactaagtatgctgactccgttaaaggtcgcttcactatctctagagacaactctaagaatactctctacttgcagatgaacagcttaagggctgaggacacagccgtgtattactgtacgagagatttcttggagtggttattactgacaagcaactacggtatggacgtctggggccgagggaccacggtcaccgtctcaagcg

SEQ ID NO: 124 - protein, 107 aa, Homo sapiens
DIQMTQSPSSLSASVGDRVTITCRASQSISSYLNWYQQKPGKAPKLLIYAASSLQSGVPSRFSGSGSGTDFALTITSLQPEDFATYFCQQSYNTPRTFGQGTKVEIK

SEQ ID NO: 125 - protein, 125 aa, Homo sapiens
EVQLLESGGGLVQPGGSLRLSCAASGFTFSPYSMQWVRQAPGKGLEWVSSIGSSGGKTKYADSVKGRFTISRDNSKNTLYLQMNSLRAEDTAVYYCTRDFLEWLLLTSNYGMDVWGRGTTVTVSS

SEQ ID NO: 126 - DNA, 322 bp, Homo sapiens
gacatccagatgacccagtctccatcctccctgtctgcatctgtaggagacagagtcaccatcacttgccgggcaagtcagagcattaacacctatttgaattggtatcagaagaaaccagggaaagcccctaagctcctgatctatgctgcatccagtttgcaaagtggggtcccatcaaggttcagtggcagtggatctgtgacagatttcactctcaccatcagcagtctgcaacctgaagattttgctacttactactgtcaacagagttacagtacccctcgcacttttggccaggggaccaagctggagatcaaac

SEQ ID NO: 127 - DNA, 376 bp, Homo sapiens
gaagttcaattgttagagtctggtggcggtcttgttcagcctggtggttctttacgtctttcttgcgctgcttccggattcactttctctttttacaatatgaattgggttcgccaagctcctggtaaaggtttggagtgggtttcttctatcgtttcttctggtggctttactgattatgctgactccgttaaaggtcgcttcactatctctagagacaactctaagaatactctctacttgcagatgaacagcttaagggctgaggacacggccgtgtattactgtgcgagagatttcttggagtggttattactgacaaccaactacggtatggacgtctggggccaagggaccacggtcaccgtctcaagcg

SEQ ID NO: 128 - protein, 376 aa, Homo sapiens
GAAGTTCAATTGTTAGAGTCTGGTGGCGGTCTTGTTCAGCCTGGTGGTTCTTTACGTCTTTCTTGCGCTGCTTCCGGATTCACTTTCTCTTTTTACAATATGAATTGGGTTCGCCAAGCTCCTGGTAAAGGTTTGGAGTGGGTTTCTTCTATCGTTTCTTCTGGTGGCTTTACTGATTATGCTGACTCCGTTAAAGGTCGCTTCACTATCTCTAGAGACAACTCTAAGAATACTCTCTACTTGCAGATGAACAGCTTAAGGGCTGAGGACACGGCCGTGTATTACTGTGCGAGAGATTTCTTGGAGTGGTTATTACTGACAACCAACTACGGTATGGACGTCTGGGGCCAAGGGACCACGGTCACCGTCTCAAGCG

SEQ ID NO: 129 - protein, 125 aa, Homo sapiens
EVQLLESGGGLVQPGGSLRLSCAASGFTFSFYNMNWVRQAPGKGLEWVSSIVSSGGFTDYADSVKGRFTISRDNSKNTLYLQMNSLRAEDTAVYYCARDFLEWLLLTTNYGMDVWGQGTTVTVSS

SEQ ID NO: 130 - DNA, 322 bp, Homo sapiens
gacatccagatgacccagtctccatcttccctgtctgcatctgtgggagacagagtcaccatcacttgccgggcaagtcaggacattagtactgctttagcctggtatcagcagaaaccaggacagactcctaaactcctgatctatgatgcctccactttggaaaggggggtcccatcacggttcagcggcagtggatctgggacagatttcactctcaccatcagcagcctgcagtctgaggattttgcaacttattactgtcaacaatttaataattacctattcactttcggccctgggacgaaagtggatgtcaaac

SEQ ID NO: 131 - DNA, 349 bp, Homo sapiens
gaagttcaattgttagagtctggtggcggtcttgttcagcctggtggttctttacgtctttcttgcgctgcttccggattcactttctctcgttactctatgacttgggttcgccaagctcctggtaaaggtttggagtgggtttctggtatccgttcttctggtggccttactcattatgctgactccgttaaaggtcgcttcactatctctagagacaactctaagaatactctctacttgcagatgaacagcttaagggctgaggacacggccgtgtattactgtgcgagagacgctgggagctactactactggggccagggaaccctggtcaccgtctcaagcg

SEQ ID NO: 132 - protein, 107 aa, Homo sapiens
DIQMTQSPSSLSASVGDRVTITCRASQDISTALAWYQQKPGQTPKLLIYDASTLERGVPSRFSGSGSGTDFTLTISSLQSEDFATYYCQQFNNYLFTFGPGTKVDVK

SEQ ID NO: 133 - protein, 116 aa, Homo sapiens
EVQLLESGGGLVQPGGSLRLSCAASGFTFSRYSMTWVRQAPGKGLEWVSGIRSSGGLTHYADSVKGRFTISRDNSKNTLYLQMNSLRAEDTAVYYCARDAGSYYYWGQGTLVTVSS

SEQ ID NO: 134 - DNA, 322 bp, Homo sapiens
gacatccagatgacccagtctccatcctccctgtctgcatctgtaggagacagagtcaccatcacttgccaggcgagtcaggacattggcacctttttaaattggtttcagcagaaaccagggagagcccctaagctcctgatctacgatgcatccaatttggagacaggggtcccatcaaggttcagtggaagtggatctgggacagattttactttcaccatcagcagcctgcagcctgaagatattgcaacatattactgtcaacagtatgattatctccccatcaccttcggccaagggacrcgactggagattaaac

SEQ ID NO: 135 - DNA, 373 bp, Homo sapiens
gaagttcaattgttagagtctggtggcggtcttgttcagcctggtggttctttacgtctttcttgcgctgcttccggattcactttctctttttaccctatgtattgggttcgccaagctcctggtaaaggtttggagtgggtttcttatatctcttcttctggtggcatgactatttatgctgactccgttaaaggtcgcttcactatctctagagacaactctaagaatactctctacttgcagatgaacagcttaagggctgaggacaccgccatgtattactgtgcgagagagtctgtagcaagatggctacaatccggggctgcttttgatatctggggccaagggacaatggtcaccgtctcaagcg

SEQ ID NO: 136 - protein, 107 aa, Homo sapiens
DIQMTQSPSSLSASVGDRVTITCQASQDIGTFLNWFQQKPGRAPKLLIYDASNLETGVPSRFSGSGSGTDFTFTISSLQPEDIATYYCQQYDYLPITFGQGTRLEIK

SEQ ID NO: 137 - protein, 124 aa, Homo sapiens
EVQLLESGGGLVQPGGSLRLSCAASGFTFSFYPMYWVRQAPGKGLEWVSYISSSGGMTIYADSVKGRFTISRDNSKNTLYLQMNSLRAEDTAMYYCARESVARWLQSGAAFDIWGQGTMVTVSS

SEQ ID NO: 138 - DNA, 322 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaratcaagc

SEQ ID NO: 139 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccagggraccctggtcaccgtctcaagcg

SEQ ID NO: 140 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDFATYFCQQSYDTPLTFGGGTKVEIK

SEQ ID NO: 141 - protein, 117 aa, Homo sapiens
EVQLLESGGGLVQPGGSLRLSCAASGFTFSAYQMGWVRQAPGKGLEWVSSISPSGGATKYADSVKGRFTISRDNSKNTLYLQMNSLRAEDTAVYYCASVSGFGELWWGQGTLVTVSS

SEQ ID NO: 142 - DNA, 322 bp, Homo sapiens
cagagcgtcttgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtgaccgtcctag

SEQ ID NO: 143 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccagggaaccctggtcaccgtctcaagcg

SEQ ID NO: 144 - protein, 107 aa, Homo sapiens
QSVLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 145 - protein, 122 aa, Homo sapiens
EVQLLESGGGLVQPGGSLRLSCAASGFTFSPYMMVWVRQAPGKGLEWVSGIYSSGGATYYADSVKGRFTISRDNSKNTLYLQMNSLRAEDTAVYYCTRHYYDSSGYLSFDYWGQGTLVTVSS

SEQ ID NO: 146 - DNA, 322 bp, Homo sapiens
gacatccagatgacccagtctccagactccctgtctgcatctgtaggagacagagtcaccatcacttgccgggccagtcagagtattagtgactgggtggcctggtatcagcagaaaccagggaaagcccctaagctcctgatctataaggcgtctattttagaaagtggggtcccatcatccttcagcggcagtggatctgggacagagttcactctcaccatcagcagcctgcagcctgatgattttgcaacttattactgccaacagtatgatagttattcgtggacgttcggccaagggaccaaggtggaaatcaaac

SEQ ID NO: 147 - DNA, 370 bp, Homo sapiens
gaagttcaattgttagagtctggtggcggtcttgttcagcctggtggttctttacgtctttcttgcgctgcttccggattcactttctctctttacaagatgttttgggttcgccaagctcctggtaaaggtttggagtgggtttctcgtatctcttcttctggtggcggtactaagtatgctgactccgttaaaggtcgcttcactatctctagagacaactctaagaatactctctacttgcagatgaacagcttaagggctgaggacacagccacatattactgtgcgagttcgtatagcagtggctggtactgggggggtgcttttgatatctggggccaagggacaatggtcaccgtctcaagcg

SEQ ID NO: 148 - protein, 107 aa, Homo sapiens
DIQMTQSPDSLSASVGDRVTITCRASQSISDWVAWYQQKPGKAPKLLIYKASILESGVPSSFSGSGSGTEFTLTISSLQPDDFATYYCQQYDSYSWTFGQGTKVEIK

SEQ ID NO: 149 - protein, 123 aa, Homo sapiens
EVQLLESGGGLVQPGGSLRLSCAASGFTFSLYKMFWVRQAPGKGLEWVSRISSSGGGTKYADSVKGRFTISRDNSKNTLYLQMNSLRAEDTATYYCASSYSSGWYWGGAFDIWGQGTMVTVSS

SEQ ID NO: 150 - DNA, 322 bp, Homo sapiens
aacatccagatgacccagtctccatcctccctgtctgcatctgtaggagacagagtcaccatcacttgccaggcgagtcaggacattggcacctttttaaattggtttcagcagaaaccagggagagcccctaagctcctgatctacgatgcatccaatttggagacaggggtcccatcaaggttcagtggaagtggatctgggacagattttactttcaccatcagcagcctgcagcctgaagatattgcaacatattactgtcaacagtatgattatctccccatcaccttcggccaagggacacgactggagattaaac

SEQ ID NO: 151 - DNA, 373 bp, Homo sapiens; identical to SEQ ID NO: 135

SEQ ID NO: 152 - protein, 107 aa, Homo sapiens
NIQMTQSPSSLSASVGDRVTITCQASQDIGTFLNWFQQKPGRAPKLLIYDASNLETGVPSRFSGSGSGTDFTFTISSLQPEDIATYYCQQYDYLPITFGQGTRLEIK

SEQ ID NO: 153 - protein, 124 aa, Homo sapiens; identical to SEQ ID NO: 137

SEQ ID NO: 154 - DNA, 322 bp, Homo sapiens
tcaggcggattgactcagccaccctcagtgtcygtctccccaggacagacagccagcgtcacttgctctggagatgcattgggacaaaaatatgcttcctggtatcaacagaagccrggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggacccaggtcaccgtcctrg

SEQ ID NO: 155 - DNA, 367 bp, Homo sapiens
gaagttcaattgttagagtctggtggcggtcttgttcagcckggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaagcg

SEQ ID NO: 156 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTQVTVL

SEQ ID NO: 157 - protein, 122 aa, Homo sapiens; identical to SEQ ID NO: 145

SEQ ID NO: 158 - DNA, 322 bp, Homo sapiens
tcaggcggattgactcagccaccctcagtgtccgtctccccaggacagacagccagcgtcacttgctctggagatgcattgggacaaaaataygcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcctrg

SEQ ID NO: 159 - DNA, 367 bp, Homo sapiens
gaagttcaattgttagagtctggtggcggtcttgtycagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaagcg

SEQ ID NO: 160 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 161 - protein, 122 aa, Homo sapiens; identical to SEQ ID NO: 145

SEQ ID NO: 162 - DNA, 322 bp, Homo sapiens
agtgcacagttgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcagtgttcggcggagggaccaaggtcaccgtcctag

SEQ ID NO: 163 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaacgc

SEQ ID NO: 164 - protein, 107 aa, Homo sapiens
SAQLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 165 - protein, 122 aa, Homo sapiens
EVQLLESGGGLVQPGGSLRLSCAASGFTFSPYMMVWVRQAPGKGLEWVSGIYSSGGATYYADSVKGRFTISRDNSKNTLYLQMNSLRAEDTAVYYCTRHYYDSSGYLSFDYWGQGTLVTVST

SEQ ID NO: 166 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtccgag

SEQ ID NO: 167 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaagcg

SEQ ID NO: 168 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVR

SEQ ID NO: 169 - protein, 122 aa, Homo sapiens; identical to SEQ ID NO: 145

SEQ ID NO: 170 - DNA, 322 bp, Homo sapiens
gacatccagacgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaaatcaagc

SEQ ID NO: 171 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccaggggacaatggtcaccgtctcaagcg

SEQ ID NO: 172 - protein, 107 aa, Homo sapiens
DIQTTQSPSSLSASVGDRVTITCQASQDISNYLNWYQQKPGKAPKLLIYDASNLETGVPSRFSGSGSGTDFTFTISSLQPEDFATYFCQQSYDTPLTFGGGTKVEIK

SEQ ID NO: 173 - protein, 117 aa, Homo sapiens
EVQLLESGGGLVQPGGSLRLSCAASGFTFSAYQMGWVRQAPGKGLEWVSSISPSGGATKYADSVKGRFTISRDNSKNTLYLQMNSLRAEDTAVYYCASVSGFGELWWGQGTMVTVSS

SEQ ID NO: 174 - DNA, 322 bp, Homo sapiens
aacatccagatgacccagtctccatcttcgctgtctgcatctgttggagacagagtcaccatcacttgtcgggcgagtcaggacattaccaattatttagcctggtttcagcagtcacctgggaaagcccctaagtccctgatctattctgcatccaatttacaaagtggggtcccatcaaagttcagcggcggtggatctgggacagatttcactctcaccatcaacaacctgcagccggaagattttgcaacttattactgccaacagtatgaaagttaccccatcaccttcggccaagggacacgactggagattaaac

SEQ ID NO: 175 - DNA, 358 bp, Homo sapiens; identical to SEQ ID NO: 95

SEQ ID NO: 176 - protein, 107 aa, Homo sapiens
NIQMTQSPSSLSASVGDRVTITCRASQDITNYLAWFQQSPGKAPKSLIYSASNLQSGVPSKFSGGGSGTDFTLTINNLQPEDFATYYCQQYESYPITFGQGTRLEIK

SEQ ID NO: 177 - protein, 119 aa, Homo sapiens; identical to SEQ ID NO: 97

SEQ ID NO: 178 - DNA, 322 bp, Homo sapiens; identical to SEQ ID NO: 150

SEQ ID NO: 179 - DNA, 373 bp, Homo sapiens
gaagttcaattgttagagtctggtggcggtcttgttcagcctggtggttctttacgtctttcttgcgctgcttccggattcactttctctttttaccctatgtattgggttcgccaagctcctggtaaaggtttggagtgggtttcttatatctcttcttctggtggcatgactatttatgctgactccgttaaaggtcgcttcactatctctagagacaactctaagaatactctctacttgcggatgaacagcttaagggctgaggacaccgccatgtattactgtgcgagagagtctgtagcaagatggctacaatccggggctgcttttgatatctggggccaagggacaatggtcaccgtctcaagcg

SEQ ID NO: 180 - protein, 107 aa, Homo sapiens; identical to SEQ ID NO: 152

SEQ ID NO: 181 - protein, 124 aa, Homo sapiens
EVQLLESGGGLVQPGGSLRLSCAASGFTFSFYPMYWVRQAPGKGLEWVSYISSSGGMTIYADSVKGRFTISRDNSKNTLYLRMNSLRAEDTAMYYCARESVARWLQSGAAFDIWGQGTMVTVSS

SEQ ID NO: 182 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggacccaggtcaccgtcccgg

SEQ ID NO: 183 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggacaatggtcaccgtctcaagcg

SEQ ID NO: 184 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTQVTVP

SEQ ID NO: 185 - protein, 122 aa, Homo sapiens
EVQLLESGGGLVQPGGSLRLSCAASGFTFSPYMMVWVRQAPGKGLEWVSGIYSSGGATYYADSVKGRFTISRDNSKNTLYLQMNSLRAEDTAVYYCTRHYYDSSGYLSFDYWGQGTMVTVSS

SEQ ID NO: 186 - DNA, 322 bp, Homo sapiens
aacatccagatgacccagtctccatcttcgctgtctgcatctgttggagacagagtcaccatcacttgtcgggcgagtcaggacattaccaattatttagcctggtttcagcagtcacctgggaaagcccctaagtccctgatctattctgcatccaatttacaaagtggggtcccatcaaagttcagcggcagtggatctgggacagatttcactctcaccatcaacaacctgcagccggaagattttgcaacttattactgccaacagtatgaaagttaccccctcaccttcggccaagggacacgactggagattaaac

SEQ ID NO: 187 - DNA, 358 bp, Homo sapiens
gaagttcaattgttagggtctggtggcggtcttgttcagcctggtggttctttacgtctttcttgcgctgcttccggattcactttctctgcttacgttatggattgggttcgccaagctcctggtaaaggtttggagtgggtttcttctatcggttcttctggtggccagactccttatgctgactccgttaaaggtcgcttcactatctctagagacaactctaagaatactctctacttgcagatgaacagcttaagggctgaggacacggccgtgtattactgtgcgagaaacgaaggactggtgggagcttttgatatctggggccaagggacaatggtcaccgtctcaagcg

SEQ ID NO: 188 - protein, 107 aa, Homo sapiens
NIQMTQSPSSLSASVGDRVTITCRASQDITNYLAWFQQSPGKAPKSLIYSASNLQSGVPSKFSGSGSGTDFTLTINNLQPEDFATYYCQQYESYPLTFGQGTRLEIK

SEQ ID NO: 189 - protein, 119 aa, Homo sapiens
EVQLLGSGGGLVQPGGSLRLSCAASGFTFSAYVMDWVRQAPGKGLEWVSSIGSSGGQTPYADSVKGRFTISRDNSKNTLYLQMNSLRAEDTAVYYCARNEGLVGAFDIWGQGTMVTVSS

SEQ ID NO: 190 - DNA, 322 bp, Homo sapiens
gacatccagatgacccagtctccatcctccctgtctgcatctgtaggagacagagtcaccatcacttgccaggcgagtcaggacattggcacctttttaaattggtttcagcagaaaccagggagagcccctaagctcctgatctacgatgcatccaatttggagacaggggtcccatcaaggttcagtggaagtggatctgggacagattttactttcaccatcagcagcctgcagcctgaagatattgcaacatattactgtcaacagtatgattatctccccatcaccttcggccaagggacacgactggagattaaac

SEQ ID NO: 191 - DNA, 373 bp, Homo sapiens
gaagttcaattgttagagtctggtggcggtcttgttcagcctggtggttctttacgtctttcttgcgctgcttccggattcactttctctttttaccctatgtattgggttcgccaagctcctggtaaaggtttggagtgggtttcttatatctcttcttctggtggcatgactatttatgctgactccgttaaaggtcgcttcactatctctagagacaactctaagaatactctctacttgcagatgagcagcttaagggctgaggacaccgccatgtattactgtgcgagagagtctgtagcaagatggctacaatccggggctgcttttgatatctggggccaagggacaatggtcaccgtctcaagcg

SEQ ID NO: 192 - protein, 107 aa, Homo sapiens; identical to SEQ ID NO: 136

SEQ ID NO: 193 - protein, 124 aa, Homo sapiens
EVQLLESGGGLVQPGGSLRLSCAASGFTFSFYPMYWVRQAPGKGLEWVSYISSSGGMTIYADSVKGRFTISRDNSKNTLYLQMSSLRAEDTAMYYCARESVARWLQSGAAFDIWGQGTMVTVSS

SEQ ID NO: 194 - DNA, 276 bp, Homo sapiens
aacatccagatgacccagtctccatcttcgctgtctgcatctgttggagacmgagtcaccatcacttgtcgggcgagtcaggacattaccaattatttagcctggtttcarcagtcacctgggaaagcccctaagtccctgatctattctgcatccaatttacaaagtggggtcccatcaaagttcagcggcagtggatctgggacagatttcactctcaccatcaacaacctgcagccggaagattttgcaacttattactgccaacagtatgaa

SEQ ID NO: 195 - DNA, 358 bp, Homo sapiens; identical to SEQ ID NO: 95

SEQ ID NO: 196 - protein, 107 aa, Homo sapiens; identical to SEQ ID NO: 188

SEQ ID NO: 197 - protein, 119 aa, Homo sapiens; identical to SEQ ID NO: 97

SEQ ID NO: 198 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcccag

SEQ ID NO: 199 - DNA, 360 bp, Homo sapiens
gaagttcaattgttagagtctggtggcggtcttgttcagcctggtggttctctacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcggatgaacagcttaagggctgaggacacagccgtgtattactgtactagacattactatgatagtagtggttattcatcctttgactactggggccaggggaccctggtcaccgtc

SEQ ID NO: 200 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVP

SEQ ID NO: 201 - protein, 122 aa, Homo sapiens
EVQLLESGGGLVQPGGSLRLSCAASGFTFSPYMMVWVRQAPGKGLEWVSGIYSSGGATYYADSVKGRFTISRDNSKNTLYLRMNSLRAEDTAVYYCTRHYYDSSGYSSFDYWGQGTLVTVSS

SEQ ID NO: 202 - DNA, 322 bp, Homo sapiens
aacatccagatgacccagtctccatcctccctgtctgcatctgtaggagacagagtcaccatcacttgccaggcgagtcaggacattggcacctttttaaattggtttcagcagaaaccagggagagcccctaagctcctgatctacgatgcatccaatttggagacagtggtcccatcaaggttcagtggaagtggatctgggacagattttactttcaccatcagcagcctgcagcctgaagatattgcaacatattactgtcaacagtatgattatctccccatcaccttcggccaagggacacgactggagattaaac

SEQ ID NO: 203 - DNA, 373 bp, Homo sapiens
gaagttcaattgttagagtctggtggcggtcttgttcagcctggtggttctttacgtctttcttgcgctgcttccggattcactttctctttttaccctatgtattgggttcgccaagctcctggtaaaggtttggagtgggtttcttatatctcttcttctggtggcatgactatttatgctgactccgttaaaggtcgcttcactatctctagagacaactctaagaatactctctacttgcagatgaacagcttaagggctgaggacaccgccatgtattactgtgcgagagagtctgtagcaagatggctacaatccggggctgcttttgatatctggggccaagggacaatggtcaccgtctcaagtg

SEQ ID NO: 204 - protein, 107 aa, Homo sapiens
NIQMTQSPSSLSASVGDRVTITCQASQDIGTFLNWFQQKPGRAPKLLIYDASNLETVVPSRFSGSGSGTDFTFTISSLQPEDIATYYCQQYDYLPITFGQGTRLEIK

SEQ ID NO: 205 - protein, 124 aa, Homo sapiens; identical to SEQ ID NO: 137

SEQ ID NO: 206 - DNA, 322 bp, Homo sapiens
aacatccagatgacccagtctccatcctccctgtctgcatctgtaggggacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaaatcaagc

SEQ ID NO: 207 - DNA, 370 bp, Homo sapiens
gaagttcaattgttagagtctggtggcggtcttgttcagcctggtggttctttacgtctttcttgcgctgcttccggattcactttctctctttacaagatgttttgggttcgccaagctcctggtaaaggtttggagtgggtttctcgtatctcttcttctggtggcggtactaagtatgctgactccgttaaaggtcgcttcactatctctagagacaactctaagaatactctctacttgcagatgaacagcttaagggctgaggacacagccacatattactgtgcgagttcgtatagcagtggctggtactgggggggtgcttttgatatctggggccaagggaccctggtcaccgtctcaagcg

SEQ ID NO: 208 - protein, 107 aa, Homo sapiens
NIQMTQSPSSLSASVGDRVTITCQASQDISNYLNWYQQKPGKAPKLLIYDASNLETGVPSRFSGSGSGTDFTFTISSLQPEDFATYFCQQSYDTPLTFGGGTKVEIK

SEQ ID NO: 209 - protein, 123 aa, Homo sapiens
EVQLLESGGGLVQPGGSLRLSCAASGFTFSLYKMFWVRQAPGKGLEWVSRISSSGGGTKYADSVKGRFTISRDNSKNTLYLQMNSLRAEDTATYYCASSYSSGWYWGGAFDIWGQGTLVTVSS

SEQ ID NO: 210 - DNA, 34 bp, Homo sapiens
accttcggccaagggacacgactggagattaaac

SEQ ID NO: 211 - DNA, 373 bp, Homo sapiens
gaagttcaattgttagagtctggtggcggtcttgttcagcctggtggttctttacgtctttcttgcgctgcttccggattcactttctctttttaccctatgtattgggttcgccaagctcctggtaaaggtttggagtgggtttcttatatctcttcttctggtggcatgactatttatgctgactccgttaaaggtcgcttcactatctctagagacaactctaagaatactctctacttgcagatgaacagcttaagggctgaggacaccgccatgtattactgtgcgagagagtctgtagcaagatggctacaatccggggctgcttttgatatctggggccaagggaccacggtcaccgtctcaagcg

SEQ ID NO: 212 - protein, 107 aa, Homo sapiens; identical to SEQ ID NO: 152

SEQ ID NO: 213 - protein, 124 aa, Homo sapiens
EVQLLESGGGLVQPGGSLRLSCAASGFTFSFYPMYWVRQAPGKGLEWVSYISSSGGMTIYADSVKGRFTISRDNSKNTLYLQMNSLRAEDTAMYYCARESVARWLQSGAAFDIWGQGTTVTVSS

SEQ ID NO: 214 - DNA, 322 bp, Homo sapiens
agtgcacagttgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcctag

SEQ ID NO: 215 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccacggtcaccgtctcaagcg

SEQ ID NO: 216 - protein, 107 aa, Homo sapiens; identical to SEQ ID NO: 164

SEQ ID NO: 217 - protein, 122 aa, Homo sapiens
EVQLLESGGGLVQPGGSLRLSCAASGFTFSPYMMVWVRQAPGKGLEWVSGIYSSGGATYYADSVKGRFTISRDNSKNTLYLQMNSLRAEDTAVYYCTRHYYDSSGYLSFDYWGQGTTVTVSS

SEQ ID NO: 218 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaggccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtccagc

SEQ ID NO: 219 - DNA, 370 bp, Homo sapiens; identical to SEQ ID NO: 147

SEQ ID NO: 220 - protein, 107 aa, Homo sapiens
SGGLTQPPSVSVSPGQTASVTCSGDALGQKYASWYQQRPGQSPVLVIFQDSKRPSGIPERFSGSNSGNTATLTISGTQAVDEADYYCQTWDSSTRAVFGGGTKVTVQ

SEQ ID NO: 221 - protein, 123 aa, Homo sapiens; identical to SEQ ID NO: 149

SEQ ID NO: 222 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggacccaggtcaccgtcctag

SEQ ID NO: 223 - DNA, 367 bp, Homo sapiens; identical to SEQ ID NO: 183

SEQ ID NO: 224 - protein, 107 aa, Homo sapiens; identical to SEQ ID NO: 156

SEQ ID NO: 225 - protein, 122 aa, Homo sapiens; identical to SEQ ID NO: 185

SEQ ID NO: 226 - DNA, 322 bp, Homo sapiens
ttcggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggactcaggctgtggatgaggccgactattactgtcagacatgggacagtagcacgagggcggtgttcggcggagggaccaaggtcaccgtcctag

SEQ ID NO: 227 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccaggggaccctggtcaccgtctcaagcg

SEQ ID NO: 228 - protein, 107 aa, Homo sapiens
FGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 229 - protein, 117 aa, Homo sapiens; identical to SEQ ID NO: 141

SEQ ID NO: 230 - DNA, 276 bp, Homo sapiens
aacatccagatgacccagtctccatcctccctgtctgcatctgtaggagacagagtcaccatcacttgccaggcgagtcaggacattagyaactatttaaattggtatcagcagaarccagggaaagcccctaagctcctgatctacgatgcatccaatttggaaacaggggtcccatcaaggttcagtggaagtggatctggracagattttactttcaccatcagcagcctgcagcctgaagattttgcaacttacttttgtcagcagagttac

SEQ ID NO: 231 - DNA, 352 bp, Homo sapiens; identical to SEQ ID NO: 139

SEQ ID NO: 232 - protein, 107 aa, Homo sapiens; identical to SEQ ID NO: 208

SEQ ID NO: 233 - protein, 117 aa, Homo sapiens; identical to SEQ ID NO: 141

SEQ ID NO: 234 - DNA, 322 bp, Homo sapiens; identical to SEQ ID NO: 186

SEQ ID NO: 235 - DNA, 358 bp, Homo sapiens
gaagttcaattgttagagtctggtggcggtcttgttcagcctggtggttctttacgtctttcttgcgctgcttccggattcactttctctgcttacgttatggattgggttcgccaagctcctggtaaaggtttggagtgggtttcttctatcggttcttctggtggccagactccttatgctgactccgttaaaggtcgcttcactatctctagagacaactctaagaatactctctacttgcagatgaacagcttaagggctgaggacacggccgtgtattactgtgcgagaaacgaaggactggtgggagcttttgatatctggggccaagggaccctggtcaccgtctcaagcg

SEQ ID NO: 236 - protein, 107 aa, Homo sapiens; identical to SEQ ID NO: 188

SEQ ID NO: 237 - protein, 119 aa, Homo sapiens
EVQLLESGGGLVQPGGSLRLSCAASGFTFSAYVMDWVRQAPGKGLEWVSSIGSSGGQTPYADSVKGRFTISRDNSKNTLYLQMNSLRAEDTAVYYCARNEGLVGAFDIWGQGTLVTVSS

SEQ ID NO: 238 - DNA, 322 bp, Homo sapiens
aacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaaatcaaac

SEQ ID NO: 239 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtgacgctactaagtatgctgactccgttaagggtcgcttcactatctctagagacaactctaagaatactctctacttgcagatgaacagcttaagggctgaggacacggccgtgtattactgtgcgagtgtgagcgggttcggggagttatggtggggccaggggaccctggtcaccgtctcaagcg

SEQ ID NO: 240 - protein, 107 aa, Homo sapiens; identical to SEQ ID NO: 208

SEQ ID NO: 241 - protein, 117 aa, Homo sapiens
EVQLLESGGGLVQPGGSLRLSCAASGFTFSAYQMGWVRQAPGKGLEWVSSISPSGDATKYADSVKGRFTISRDNSKNTLYLQMNSLRAEDTAVYYCASVSGFGELWWGQGTLVTVSS

SEQ ID NO: 242 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcctag

SEQ ID NO: 243 - DNA, 367 bp, Homo sapiens; identical to SEQ ID NO: 215

SEQ ID NO: 244 - protein, 107 aa, Homo sapiens; identical to SEQ ID NO: 160

SEQ ID NO: 245 - protein, 122 aa, Homo sapiens; identical to SEQ ID NO: 217

SEQ ID NO: 246 - DNA, 322 bp, Homo sapiens
aacatccagatgacccagtctccatcttcgctgtatgcatctgttggagacagagtcaccatcacttgtcgggcgagtcaggacattaccaattatttagcctggtttcagcagtcacctgggaaagcccctaagtccctgatctattctgcatccaatttacaaagtggggtcccatcaaagttcagcggcagtggatctgggacagatttcactctcaccatcaacaacctgcagccggaagattttgcaacttattactgccaacagtatgaaagttaccccctcaccttcggccaagggacacgactggagattaaac

SEQ ID NO: 247 - DNA, 358 bp, Homo sapiens; identical to SEQ ID NO: 95

SEQ ID NO: 248 - protein, 107 aa, Homo sapiens
NIQMTQSPSSLYASVGDRVTITCRASQDITNYLAWFQQSPGKAPKSLIYSASNLQSGVPSKFSGSGSGTDFTLTINNLQPEDFATYYCQQYESYPLTFGQGTRLEIK

SEQ ID NO: 249 - protein, 119 aa, Homo sapiens; identical to SEQ ID NO: 97

SEQ ID NO: 250 - DNA, 322 bp, Homo sapiens; identical to SEQ ID NO: 166

SEQ ID NO: 251 - DNA, 367 bp, Homo sapiens; identical to SEQ ID NO: 215

SEQ ID NO: 252 - protein, 107 aa, Homo sapiens; identical to SEQ ID NO: 168

SEQ ID NO: 253 - protein, 122 aa, Homo sapiens; identical to SEQ ID NO: 217

SEQ ID NO: 254 - DNA, 322 bp, Homo sapiens
aacatccagatgacccagtctccatcctccctgtctgcatctgtaggagacagagtcaccatcacttgccgggcaagtcagaacattaacacctatttgaattggtatcagaagaaaccagggaaagcccctaagctcctgatctatgctgcatccagtttgcaaagtggggtcccatcaaggttcagtggcagtggatctgtgacagatttcactctcaccatcagcagtctgcaacctgaagattttgctacttactactgtcaacagagttacagtacccctcgcacttttggccaggggaccaagctggagattaaac

SEQ ID NO: 255 - DNA, 376 bp, Homo sapiens; identical to SEQ ID NO: 99

SEQ ID NO: 256 - protein, 107 aa, Homo sapiens
NIQMTQSPSSLSASVGDRVTITCRASQNINTYLNWYQKKPGKAPKLLIYAASSLQSGVPSRFSGSGSVTDFTLTISSLQPEDFATYYCQQSYSTPRTFGQGTKLEIK

SEQ ID NO: 257 - protein, 72 aa, Homo sapiens
EVQLLESGGGLVQPGGSLRLSCAASGFTFSEYNMNWVRQAPGKGLEWVSWIGPSGGQTDYADSVKGRFTISR

SEQ ID NO: 258 - DNA, 322 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaaatcaagc

SEQ ID NO: 259 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccaggggaccacggtcaccgtctcaagag

SEQ ID NO: 260 - protein, 107 aa, Homo sapiens; identical to SEQ ID NO: 140

SEQ ID NO: 261 - protein, 117 aa, Homo sapiens
EVQLLESGGGLVQPGGSLRLSCAASGFTFSAYQMGWVRQAPGKGLEWVSSISPSGGATKYADSVKGRFTISRDNSKNTLYLQMNSLRAEDTAVYYCASVSGFGELWWGQGTTVTVSR

SEQ ID NO: 262 - DNA, 322 bp, Homo sapiens; identical to SEQ ID NO: 242

SEQ ID NO: 263 - DNA, 343 bp, Homo sapiens
attgttagatctggtggcggtcttgttcagcctggtggttctttacgtctttcttgcgctgcttccggattcactttctctgcttaccagatgagttgggttcgccaagctcctggtaaaggtttggagtgggtttcttctatctctccttctggtggcgctactaagtatgctgactccgttaaaggtcgcttcactatctctagagacaactctaagaatactctctacatgcagatgaacagcttaagggctgaggacacggccgtgtattactgtgcgagtgtgagcgggttcggggagttatggtggggccaggggaccctggtcaccgtctcaagcg

SEQ ID NO: 264 - protein, 107 aa, Homo sapiens; identical to SEQ ID NO: 160

SEQ ID NO: 265 - protein, 114 aa, Homo sapiens
IVRSGGGLVQPGGSLRLSCAASGFTFSAYQMSWVRQAPGKGLEWVSSISPSGGATKYADSVKGRFTISRDNSKNTLYMQMNSLRAEDTAVYYCASVSGFGELWWGQGTLVTVSS

SEQ ID NO: 266 - DNA, 322 bp, Homo sapiens
aacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacttacttttgtcagcagagttacgataccccgctcactttcggcggagggaccaaggtggaaatcaagc

SEQ ID NO: 267 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccaggggacgatggtcaccgtctcaagcg

SEQ ID NO: 268 - protein, 107 aa, Homo sapiens; identical to SEQ ID NO: 208

SEQ ID NO: 269 - protein, 117 aa, Homo sapiens; identical to SEQ ID NO: 173

SEQ ID NO: 270 - DNA, 322 bp, Homo sapiens
aacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatcttgcaacttacttttgtcagcagagttacgataccccgctcactttcggcggagggaccaaggtggaaatcaagc

SEQ ID NO: 271 - DNA, 352 bp, Homo sapiens; identical to SEQ ID NO: 227

SEQ ID NO: 272 - protein, 107 aa, Homo sapiens
NIQMTQSPSSLSASVGDRVTITCQASQDISNYLNWYQQKPGKAPKLLIYDASNLETGVPSRFSGSGSGTDFTFTISSLQPEDLATYFCQQSYDTPLTFGGGTKVEIK

SEQ ID NO: 273 - protein, 117 aa, Homo sapiens; identical to SEQ ID NO: 141

SEQ ID NO: 274 - DNA, 322 bp, Homo sapiens; identical to SEQ ID NO: 186

SEQ ID NO: 275 - DNA, 358 bp, Homo sapiens
gaagtccaattgttagagtctggtggcggtcttgttcagcctggtggttctttacgtctttcttgcgctgcttccggattcactttctctgcttacgttatggattgggttcgccaagctcctggtaaaggtttggagtgggtttcttctatcggttcttctggtggccagactccttatgctgactccgttaaaggtcgcttcactatcactagagacaactctaagaatactctctacttgcagatgaacagcttaagggctgaggacacggccgtgtattactgtgcgagaaacgaaggactggtgggagcttttgatatctggggccaagggacaatggtcaccgtctcaagcg

SEQ ID NO: 276 - protein, 107 aa, Homo sapiens; identical to SEQ ID NO: 188

SEQ ID NO: 277 - protein, 119 aa, Homo sapiens
EVQLLESGGGLVQPGGSLRLSCAASGFTFSAYVMDWVRQAPGKGLEWVSSIGSSGGQTPYADSVKGRFTITRDNSKNTLYLQMNSLRAEDTAVYYCARNEGLVGAFDIWGQGTMVTVSS

SEQ ID NO: 278 - DNA, 322 bp, Homo sapiens; identical to SEQ ID NO: 198

SEQ ID NO: 279 - DNA, 367 bp, Homo sapiens; identical to SEQ ID NO: 215

SEQ ID NO: 280 - protein, 107 aa, Homo sapiens; identical to SEQ ID NO: 200

SEQ ID NO: 281 - protein, 122 aa, Homo sapiens; identical to SEQ ID NO: 217

SEQ ID NO: 282 - DNA, 322 bp, Homo sapiens; identical to SEQ ID NO: 238

SEQ ID NO: 283 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtctggagtgggtttctggtatctattcttctggtggcgctacttattatgctgactctgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaagcg

SEQ ID NO: 284 - protein, 107 aa, Homo sapiens; identical to SEQ ID NO: 208

SEQ ID NO: 285 - protein, 122 aa, Homo sapiens; identical to SEQ ID NO: 145

SEQ ID NO: 286 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgcccaag

SEQ ID NO: 287 - DNA, 367 bp, Homo sapiens; identical to SEQ ID NO: 183

SEQ ID NO: 288 - protein, 107 aa, Homo sapiens
SGGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTAQ

SEQ ID NO: 289 - protein, 122 aa, Homo sapiens; identical to SEQ ID NO: 185

SEQ ID NO: 290 - DNA, 319 bp, Homo sapiens
gcacagttgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcctag

SEQ ID NO: 291 - DNA, 367 bp, Homo sapiens; identical to SEQ ID NO: 167

SEQ ID NO: 292 - protein, 106 aa, Homo sapiens
AQLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 293 - protein, 122 aa, Homo sapiens; identical to SEQ ID NO: 145

SEQ ID NO: 294 - DNA, 322 bp, Homo sapiens
ttcagcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcccag

SEQ ID NO: 295 - DNA, 367 bp, Homo sapiens; identical to SEQ ID NO: 167

SEQ ID NO: 296 - protein, 107 aa, Homo sapiens
FSGLTQPPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVP

SEQ ID NO: 297 - protein, 122 aa, Homo sapiens; identical to SEQ ID NO: 145

SEQ ID NO: 298 - DNA, 288 bp, Homo sapiens
tcaggcggattgactcagccaccctcagtgaccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcg

SEQ ID NO: 299 - DNA, 367 bp, Homo sapiens; identical to SEQ ID NO: 167

SEQ ID NO: 300 - protein, 107 aa, Homo sapiens
SGGLTQPPSVTVSPGQTASVTCSGDALGQKYASWYQQKPGQSPVLVIFQDSKRPSGIPERFSGSNSGNTATLTISGTQAVDEADYYCQTWDSSTRAVFGGGTKVTVL

SEQ ID NO: 301 - protein, 122 aa, Homo sapiens; identical to SEQ ID NO: 145

SEQ ID NO: 302 - DNA, 322 bp, Homo sapiens
tcaggcggattgactcagtcaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtccgag

SEQ ID NO: 303 - DNA, 367 bp, Homo sapiens
gaagttcaattgttagagtctggtggcggtcttgttcagcctggtggttctttacgtctttcttgcgctgcttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctatttgcagatgaacagcttaagggctgaggacacagccgtgtattactgtactagacattactatgatagtagtggttatttatcctttgactactggggccaggggaccctggtcaccgtctcaagcg

SEQ ID NO: 304 - protein, 107 aa, Homo sapiens
SGGLTQSPSVSVSPGQTASVTCSGDALGQKYASWYQQKPGQSPVLVIFQDSKRPSGIPERFSGSNSGNTATLTISGTQAVDEADYYCQTWDSSTRAVFGGGTKVTVR

SEQ ID NO: 305 - protein, 122 aa, Homo sapiens; identical to SEQ ID NO: 145

SEQ ID NO: 306 - DNA, 322 bp, Homo sapiens; identical to SEQ ID NO: 266

SEQ ID NO: 307 - DNA, 352 bp, Homo sapiens
gaagttcaattgttagagtctggtggcggtcttgttcagcctggtggttctttacgtctttcttgcgctgcttccggattcactttctctgcttaccagatgggttgggttcgccaagctcctggtaaaggtttggagtgggtttcttctatctctccttctggtggcgctactaagtatgctgactccgttaaaggtcgcttcactatctctagagacaactctaagaatactctctacttgcagatgaacagcttaagggctgaggacacggccgtgtattactgtgcgagtgtgagcgggttcggggagttatggtggggccaggggaccacggtcaccgtctcaagcg

SEQ ID NO: 308 - protein, 107 aa, Homo sapiens; identical to SEQ ID NO: 208

SEQ ID NO: 309 - protein, 117 aa, Homo sapiens
EVQLLESGGGLVQPGGSLRLSCAASGFTFSAYQMGWVRQAPGKGLEWVSSISPSGGATKYADSVKGRFTISRDNSKNTLYLQMNSLRAEDTAVYYCASVSGFGELWWGQGTTVTVSS

SEQ ID NO: 310 - DNA, 322 bp, Homo sapiens
tcaggcggattgactcagccaccctcagtgtccgtctccccaggacagacagccagcgtcacttgctctggagatgcattgggacaaaaatatgcttcctggtatcaacagaagccaggccagtcccctgtactggtcatctttcaagattccaagcggccctcagggatccctgagcggttctctggctccaattctgggaacacagccactctgaccatcagcgggacccaggctgtggatgaggccgactattactgtcagacatgggacagtagcacgagggcggtgttcggcggagggaccaaggtcaccgtcccgg

SEQ ID NO: 311 - DNA, 367 bp, Homo sapiens
gaagttcaattgttagagtctggtggcggtcttgttcagcctggtggttctttacgtctttcttgcactacttccggattcactttctctccttacatgatggtttgggttcgccaagctcctggtaaaggtttggagtgggtttctggtatctattcttctggtggcgctacttattatgctgactccgttaaaggtcgcttcactatctctagagacaactctaagaatactctctacttgcagatgaacagcttaagggctgaggacacagccgtgtattactgtactagacattactatgatagtagtggttatttatcctttgactactggggccaggggaccctggtcaccgtctcaagcg

SEQ ID NO: 312 - protein, 107 aa, Homo sapiens; identical to SEQ ID NO: 200

SEQ ID NO: 313 - protein, 122 aa, Homo sapiens
EVQLLESGGGLVQPGGSLRLSCTTSGFTFSPYMMVWVRQAPGKGLEWVSGIYSSGGATYYADSVKGRFTISRDNSKNTLYLQMNSLRAEDTAVYYCTRHYYDSSGYLSFDYWGQGTLVTVSS

SEQ ID NO: 314 - DNA, 322 bp, Homo sapiens; identical to SEQ ID NO: 242

SEQ ID NO: 315 - DNA, 370 bp, Homo sapiens
caattgttagagtctggtggcggtcttgttcagcctggtggttctttacgtctttcttgcgctgcttccggattcactttctctttttacaatatgaattgggttcgccaagctcctggtaaaggtttggagtgggtttcttctatcgtttcttctggtggctttactgattatgctgactccgttaaaggtcgcttcactatctctagagacaactctaagaatactctctacttgcagatgaacagcttaagggctgaggacacggccgtgtattactgtgcgagagatttcttggagtggttattactgacaaccaactacggtatggacgtctggggccaagggaccacggtcaccgtctcaagcg

SEQ ID NO: 316 - protein, 107 aa, Homo sapiens; identical to SEQ ID NO: 160

SEQ ID NO: 317 - protein, 123 aa, Homo sapiens
QLLESGGGLVQPGGSLRLSCAASGFTFSFYNMNWVRQAPGKGLEWVSSIVSSGGFTDYADSVKGRFTISRDNSKNTLYLQMNSLRAEDTAVYYCARDFLEWLLLTTNYGMDVWGQGTTVTVSS

SEQ ID NO: 318 - DNA, 322 bp, Homo sapiens
aacatccagatgacccagtctccagactccctgtctgcatctgtaggagacagagtcaccatcacttgccgggccagtcagagtattagtgactgggtggcctggtatcagcagaaaccagggaaagcccctaagctcctgatctataaggcgtctattttagaaagtggggtcccatcatccttcagcggcagtggatctgggacagagttcactctcaccatcagcagcctgcagcctgatgattttgcaacttattactgccaacagtatgaaagttaccccctcaccttcggccaagggacacgactggagattaaac

SEQ ID NO: 319 - DNA, 370 bp, Homo sapiens; identical to SEQ ID NO: 147

SEQ ID NO: 320 - protein, 107 aa, Homo sapiens
NIQMTQSPDSLSASVGDRVTITCRASQSISDWVAWYQQKPGKAPKLLIYKASILESGVPSSFSGSGSGTEFTLTISSLQPDDFATYYCQQYESYPLTFGQGTRLEIK

SEQ ID NO: 321 - protein, 123 aa, Homo sapiens; identical to SEQ ID NO: 149

SEQ ID NO: 322 - DNA, 382 bp, Homo sapiens
gaagttcaattgttagagtctggtggcggtcttgttcagcctggtggttctttacgtctttcttgcgctgcttccggattcactttctctcagtactctatgatttgggttcgccaagctcctggtaaaggtttggagtgggtttcttctatctctccttctggtggcgttactttttatgctgactccgttaaaggtcgcttcactatctctagagacaactctaagaatactctctacttgcagatgaacagcttaagggctgaggacacagccacatattactgtgcacggacgtactatagcagcatcacgatgtggggcaactactactacggtatggacgtctggggccaagggaccacggtcaccgtctcaagcg

SEQ ID NO: 323 - protein, 127 aa, Homo sapiens
EVQLLESGGGLVQPGGSLRLSCAASGFTFSQYSMIWVRQAPGKGLEWVSSISPSGGVTFYADSVKGRFTISRDNSKNTLYLQMNSLRAEDTATYYCARTYYSSITMWGNYYYGMDVWGQGTTVTVSS

SEQ ID NO: 324 - DNA, 331 bp, Homo sapiens
acagtacaattgactcagccaccctcagcgtctgggacccccgggcagagggtcaccatctcttgttctggaggcagctccaacatcggacttaatcctgtaaactggtaccagcagctcccaggaacggcccccaaactcctcatctctaatgataatcagcggccctcaggggtccctgaccgattctctggctccaagtctggcacctcagcctccctggccatcagtgggctccagtctgaggatgaggctgattattactgtgcagcatgggatgacagcctgaatggtgtggtgtttggcggagggaccaagctgaccgtcctag

SEQ ID NO: 325 - protein, 110 aa, Homo sapiens
TVQLTQPPSASGTPGQRVTISCSGGSSNIGLNPVNWYQQLPGTAPKLLISNDNQRPSGVPDRFSGSKSGTSASLAISGLQSEDEADYYCAAWDDSLNGVVFGGGTKLTVL

SEQ ID NO: 326 - protein, 12 aa, Homo sapiens
  VARIANT (1)...(1): Xaa is Arg or Trp
  VARIANT (4)...(4): Xaa is Gln or Glu
  VARIANT (5)...(5): Xaa is  Ser ir Thr
  VARIANT (6)...(6): Xaa is Val or Ile
  CONFLICT (7)...(7): Xaa is Ser or Lys
  VARIANT (8)...(8): Xaa is Ser, Leu, Asn, or no amino  acid
  VARIANT (9)...(9): Xaa is Ser, Asn, Arg, or Ala
  VARIANT (10)...(10): Xaa is Tyr, Ser, Phe,  or Asp
XASXXXXXXXLA

SEQ ID NO: 327 - protein, 7 aa, Homo sapiens
  VARIANT (1)...(1): Xaa is Gly, Tyr,. or Asp
  VARIANT (4)...(4): Xaa is Asn, Thr, Ser or Tyr
  VARIANT (7)...(7): Xaa is Thr or Ser
XASXRAX

SEQ ID NO: 328 - protein, 12 aa, Homo sapiens
  VARIANT (3)...(3): Xaa is Tyr or Phe
  VARIANT (4)...(4): Xaa is Gln or no amino acid
  VARIANT (5)...(5): Xaa is Ala, Ser, Gly or Gln
  VARIANT (6)...(6): Xaa is  Thr, Ser, Arg, Val. Ile or no amino acid
  VARIANT (8)...(8): Xaa is Pro, Ser, Thr, or no amino acid
  VARIANT (9)...(9): Xaa is Pro, Arg, or no amino acid
  VARIANT (10)...(0): Xaa is Lys, Als, or no amino acid
  VARIANT (11)...(11): Xaa is Arg, Trp, Tyr, Phe, Ile, Leu, or no amino acid
  VARIANT (12)...(12): Xaa is Thr or Ser
QQXXXXSXXXXX

SEQ ID NO: 329 - protein, 5 aa, Homo sapiens
  VARIANT (1)...(1): Xaa is Asn, Lys, Arg, Pro, Leu, Trp, Ile, Met, His
  VARIANT (3)...(3): Xaa is Ser, Phe, Gly, Thr, Lys, His, Asn, Ala or Arg
  VARIANT (5)...(5): Xaa is Ser, Asn, His, Met, Gly, Thr, Ile Tyr, or Val
XYXMX

SEQ ID NO: 330 - protein, 17 aa, Homo sapiens
  VARIANT (1)...(1): Xaa is Ser, Tyr, Arg, Gly
  VARIANT (3)...(3): Xaa is Arg, Ser, Val, Tyr or Gly
  VARIANT (4)...(4): Xaa is Ser or Pro
  VARIANT (8)...(8): Xaa is Arg, Ala, Tyr, Trp, Val, Asp, Phe Pro, Asn
  VARIANT (10)...(10): Xaa is Asp, Thr, Glu, Ser, Asn, Gly, Leu. or Ile
XIXXSGGXTXYADSVKG

SEQ ID NO: 331 - protein, 7 aa, Homo sapiens
GIAVARY

SEQ ID NO: 332 - protein, 10 aa, Homo sapiens
VGYTNWSIDN

SEQ ID NO: 333 - protein, 11 aa, Homo sapiens
GQQWPGVAFEI

SEQ ID NO: 334 - protein, 9 aa, Homo sapiens
DVTWWPRSY

SEQ ID NO: 335 - protein, 14 aa, Homo sapiens
DWRGSSWLPTGMDV

SEQ ID NO: 336 - protein, 14 aa, Homo sapiens
AYDFWSGYPSAFDI

SEQ ID NO: 337 - protein, 9 aa, Homo sapiens
AKWGWYFDL

SEQ ID NO: 338 - protein, 9 aa, Homo sapiens
IMWYGQFDY

SEQ ID NO: 339 - protein, 16 aa, Homo sapiens
GGITIFGVVIIPAFDI

SEQ ID NO: 340 - protein, 15 aa, Homo sapiens
TLFYYDDSHDKYFDR

SEQ ID NO: 341 - protein, 12 aa, Homo sapiens
  VARIANT (1)...(1): Xaa is Arg or Trp
  VARIANT (2)...(2): Xaa is Ala or Ser
  VARIANT (5)...(5): Xaa is is Ser, Pro, or Asn
  VARIANT (6)...(6): Xaa is Val or Ile
  VARIANT (7)...(7): Xaa is Ser, Leu, Gly, or Lys
  VARIANT (8)...(8): Xaa is Ser or no amino acid
  VARIANT (9)...(9): Xaa is Asn, Ile, or Ser
  VARIANT (10)...(10): Xaa is Lys, Asn, or Tyr
XXSQXXXXXXLA

SEQ ID NO: 342 - protein, 7 aa, Homo sapiens
  VARIANT (1)...(1): Xaa is Gly, Ser, or Asp
  CONFLICT (3)...(3): Xaa is Ser or Thr
  VARIANT (4)...(4): Xaa is Ser or Thr
XAXXRAT

SEQ ID NO: 343 - protein, 10 aa, Homo sapiens
  VARIANT (1)...(1): Xaa is Gln or His
  VARIANT (2)...(2): Xaa is Gln or His
  VARIANT (3)...(3): Xaa is Arg, Tyr or Ser
  VARIANT (4)...(4): Xaa is Ile, Asn, His, Asp, or Tyr
  VARIANT (5)...(5): Xaa is Asn, Arg, Tyr, Val, Ser, or Asp
  VARIANT (6)...(6): Xaa is Trp or Thr
  VARIANT (7)...(7): Xaa is Pro, ser, or no amino acid
  VARIANT (8)...(8): Xaa is Pro or no amino acid
  VARIANT (9)...(9): Xaa is Leu, Ile, Arg, Phe, or Gly
XXXXXXXXXT

SEQ ID NO: 344 - protein, 5 aa, Homo sapiens
  VARIANT (1)...(1): Xaa  is Thr, Tyr, Asn, Lys, His, or Arg
  VARIANT (3)...(3): Xaa is Trp, SEr, ASn, Arg, Ala or Asp
  VARIANT (5)...(5): Xaa is GLe, Asp, Ser, Phe, Gly or Asn
XYXMX

SEQ ID NO: 345 - protein, 17 aa, Homo sapiens
  VARIANT (1)...(1): Xaa is Ser, Arg, Val, Tyr, or Gly
  VARIANT (3)...(3): Xaa is Val, Tyr, Arg, Gly, or Trp
  VARIANT (4)...(4): Xaa is  Ser or Pro
  VARIANT (8)...(8): Xaa is Pro, Met, Arg, Thr, Lue, Trp, or Phe
  VARIANT (10)...(10): Xaa is Met, Trp, Asp, Gly, Ser Phe, or Gln
XIXXSGGXTXYADSVKG

SEQ ID NO: 346 - protein, 9 aa, Homo sapiens
GRLNGYFDL

SEQ ID NO: 347 - protein, 10 aa, Homo sapiens
EKGIAAAYDY

SEQ ID NO: 348 - protein, 5 aa, Homo sapiens
GALGQ

SEQ ID NO: 349 - protein, 9 aa, Homo sapiens
VSEYGSFDY

SEQ ID NO: 350 - protein, 11 aa, Homo sapiens
VRVGSTGNFDY

SEQ ID NO: 351 - protein, 14 aa, Homo sapiens
GGGYSSSRSAGMDV

SEQ ID NO: 352 - protein, 15 aa, Homo sapiens
AREISIFGVVKDLDI

SEQ ID NO: 353 - protein, 11 aa, Homo sapiens
  VARIANT (6)...(6): Xaa is Val, Ile or Tyr
  VARIANT (7)...(7): Xaa is Ser, Gly or Ile
  VARIANT (8)...(8): Xaa is Ser, Gly, Asn or Arg
  VARIANT (9)...(9): Xaa is Tyr, or Asn
RASQSXXXXLA

SEQ ID NO: 354 - protein, 7 aa, Homo sapiens
  VARIANT (1)...(1): Xaa  is Asp, Tyr, Ser or His
  VARIANT (2)...(2): Xaa  is Ala or Thr
  VARIANT (4)...(4): Xaa  is Asn, Thr, or Tyr
XXSXRAT

SEQ ID NO: 355 - protein, 11 aa, Homo sapiens
  VARIANT (2)...(2): Xaa  is Gln or His
  VARIANT (5)...(5): Xaa  is Asn or Lys
  VARIANT (6)...(6): Xaa  is Trp or Ser
  VARIANT (8)...(8): Xaa  is Pro, Met, or no amino acid
  VARIANT (9)...(9): Xaa  is Glu or no amino acid
  VARIANT (10)...(10): Xaa  is Trp, Leu, Phe or no amino acid
QXRSXXPXXXT

SEQ ID NO: 356 - protein, 5 aa, Homo sapiens
  VARIANT (1)...(1): Xaa  is Lys, Arg, Pro, Asp, Ala, Val
  VARIANT (3)...(3): Xaa  is Trp, Ala, Gle, Lys, Thr
  VARIANT (5)...(5): Xaa  is Ala, Gly, Ile, Val, Met, Ser, Tyr
XYXMX

SEQ ID NO: 357 - protein, 17 aa, Homo sapiens
  VARIANT (1)...(1): Xaa is Tyr, Ar, Val, Ser, Trp
  VARIANT (3)...(3): Xaa is Ser, Gly
  VARIANT (4)...(4): Xaa is Pro, Ser
  VARIANT (8)...(8): Xaa is Trp, Met, Asn, Gly, Pro, Ser
  VARIANT (10)...(10): Xaa is Arg, Trp, Ser, Tyr, His, Val
XIXXSGGXTXYADSVKG

SEQ ID NO: 358 - protein, 12 aa, Homo sapiens
VGGSYSLGALDI

SEQ ID NO: 359 - protein, 11 aa, Homo sapiens
DRRIFDYAFDI

SEQ ID NO: 360 - protein, 16 aa, Homo sapiens
DKGSGWRRYYYYGMDV

SEQ ID NO: 361 - protein, 10 aa, Homo sapiens
LSITQGWFDP

SEQ ID NO: 362 - protein, 11 aa, Homo sapiens
LAYSSGWYDDY

SEQ ID NO: 363 - protein, 15 aa, Homo sapiens
DMGGIAARQAGGFGY

SEQ ID NO: 364 - protein, 9 aa, Homo sapiens
SRTTPGGFD

SEQ ID NO: 365 - protein, 16 aa, Homo sapiens
  VARIANT (5)...(5): Xaa = Ser or Gly
RSSQXLVYSDGNTYLN

SEQ ID NO: 366 - protein, 7 aa, Homo sapiens
KVSNRDS

SEQ ID NO: 367 - protein, 9 aa, Homo sapiens
MQGTHWPIT

SEQ ID NO: 368 - protein, 5 aa, Homo sapiens
  VARIANT (1)...(1): Xaa = Arg or Ala
  VARIANT (3)...(3): Xaa = Ala or Gly
  VARIANT (5)...(5): Xaa = Trp or Asp
XYXMX

SEQ ID NO: 369 - protein, 17 aa, Homo sapiens
  VARIANT (1)...(1): Xaa = Gly or Ser
  VARIANT (3)...(3): Xaa = Val or Ser
  VARIANT (8)...(8): Xaa = Leu or Gln
  VARIANT (10)...(10): Xaa = Thr or Lys
XIXPSGGXTXYADSVKG

SEQ ID NO: 370 - protein, 15 aa, Homo sapiens
HEVSEQWLFPGNFDY

SEQ ID NO: 371 - protein, 7 aa, Homo sapiens
VHDAFDI

SEQ ID NO: 372 - protein, 14 aa, Homo sapiens
DLGGGYYYYYGMDV

SEQ ID NO: 373 - protein, 16 aa, Homo sapiens
  VARIANT (1)...(1): Xaa = Arg, Met or Lys
  VARIANT (7)...(7): Xaa = Leu or Gln
  VARIANT (8)...(8): Xaa = His, Glu, Asp, Gln or Tyr
  VARIANT (9)...(9): Xaa = Ser, Thr, Arg, Asn, Gly or Phe
  VARIANT (10)...(10): Xaa = Asn or His
  VARIANT (12)...(12): Xaa = Tyr or His
  VARIANT (13)...(13): Xaa = Asn or Ser
  VARIANT (14)...(14): Xaa = Tyr or His
  VARIANT (15)...(15): Xaa = Leu or Val
  VARIANT (16)...(16): Xaa = Asp or Ala
XSSQSLXXXXGXXXXX

SEQ ID NO: 374 - protein, 7 aa, Homo sapiens
  VARIANT (1)...(1): Xaa = Leu or Met
  VARIANT (2)...(2): Xaa = Gly or Ala
  VARIANT (3)...(3): Xaa = Ser or Ala
  VARIANT (4)...(4): Xaa = Asn, His or Tyr
XXXXRAS

SEQ ID NO: 375 - protein, 10 aa, Homo sapiens
  VARIANT (1)...(1): Xaa = Met or Val
  VARIANT (2)...(2): Xaa = Gln or Glu
  VARIANT (3)...(3): Xaa = Ala, Gly, Leu, Ser or Thr
  VARIANT (4)...(4): Xaa = Leu, Arg or Thr
  VARIANT (5)...(5): Xaa = Gln, Glu or His
  VARIANT (6)...(6): Xaa = Asn, Ser, Thr, Ile, Ala or Trp
  VARIANT (7)...(7): Xaa = Ser, Arg, Pro or not present
  VARIANT (8)...(8): Xaa = not present or Pro
  VARIANT (9)...(9): Xaa = Ile, Tyr, Leu, Pro, Gln, His, Trp or not present
  VARIANT (10)...(10): Xaa = Thr or Ala
XXXXXXXXXX

SEQ ID NO: 376 - protein, 5 aa, Homo sapiens
  VARIANT (1)...(1): Xaa = Val, Trp, Ala, Gln, Lys, Met, Leu, Asp, Asn, His, Arg, Pro, Gly or Ser
  VARIANT (3)...(3): Xaa = Ala, Gly, Val, Asn, Trp, Pro, Ser, Met, Arg, His, Thr or Phe
  VARIANT (5)...(5): Xaa = His, Val, Met, Leu, Arg, Asn, Thr, Gly, Gln, Ser, Ile, Trp or Asp
XYXMX

SEQ ID NO: 377 - protein, 17 aa, Homo sapiens
  VARIANT (1)...(1): Xaa = Val, Ser, Gly, Tyr or Arg
  VARIANT (2)...(2): Xaa = Ile or Thr
  VARIANT (3)...(3): Xaa = Ser, Trp, Gly, Val, Tyr or Pro
  VARIANT (4)...(4): Xaa = Pro or Ser
  VARIANT (8)...(8): Xaa = Phe, Ser, Gly, Glu, Gln, Ala, Asp, Lys, Ile, Pro, Arg, His or Leu
  VARIANT (10)...(10): Xaa = Phe, Asp, Gln, Lys, Arg, Pro, His, Leu, Thr, Gly, Met, Glu or Ser
XXXXSGGXTXYADSVKG

SEQ ID NO: 378 - protein, 10 aa, Homo sapiens
GGYYYDVPYY

SEQ ID NO: 379 - protein, 10 aa, Homo sapiens
SMGYGDAFDI

SEQ ID NO: 380 - protein, 9 aa, Homo sapiens
SGSTWYFDL

SEQ ID NO: 381 - protein, 13 aa, Homo sapiens
GVRGYGDYWYFDL

SEQ ID NO: 382 - protein, 9 aa, Homo sapiens
GGPGWYFDL

SEQ ID NO: 383 - protein, 13 aa, Homo sapiens
VMGYYYYYYGMDV

SEQ ID NO: 384 - protein, 10 aa, Homo sapiens
VDQWLRSNDY

SEQ ID NO: 385 - protein, 9 aa, Homo sapiens
GGDYYYMDV

SEQ ID NO: 386 - protein, 15 aa, Homo sapiens
GTHGGGPPWYYYMDV

SEQ ID NO: 387 - protein, 14 aa, Homo sapiens
GGGYSYGFPLPFDY

SEQ ID NO: 388 - protein, 9 aa, Homo sapiens
GAMGSAFDI

SEQ ID NO: 389 - protein, 11 aa, Homo sapiens
AAPIYNYYMDV

SEQ ID NO: 390 - protein, 14 aa, Homo sapiens
GGYDSSGYYYYFDL

SEQ ID NO: 391 - protein, 15 aa, Homo sapiens
DLGSYSSGWGGWFDP

SEQ ID NO: 392 - protein, 12 aa, Homo sapiens
GPGGGNTYYFDY

SEQ ID NO: 393 - protein, 10 aa, Homo sapiens
AAPSGWYYDY

SEQ ID NO: 394 - protein, 12 aa, Homo sapiens
GTTVWWNYYMDV

SEQ ID NO: 395 - protein, 13 aa, Homo sapiens
HYGSGSYYASLDY

SEQ ID NO: 396 - protein, 11 aa, Homo sapiens
SGTGYYYYMDV

SEQ ID NO: 397 - protein, 15 aa, Homo sapiens
HEVSEQWLFPGNFDY

SEQ ID NO: 398 - protein, 8 aa, Homo sapiens
VGLWAFDI

SEQ ID NO: 399 - protein, 12 aa, Homo sapiens
VVRGYYYYGMDV

SEQ ID NO: 400 - protein, 14 aa, Homo sapiens
DLGGGYYYYYGMDV

SEQ ID NO: 401 - protein, 7 aa, Homo sapiens
VHDAFDI

SEQ ID NO: 402 - protein, 17 aa, Homo sapiens
GGYDYVWGSYRPYYFDY

SEQ ID NO: 403 - protein, 9 aa, Homo sapiens
VGSSWYLDV

SEQ ID NO: 404 - protein, 14 aa, Homo sapiens
GGYSWGYYYYYMDV

SEQ ID NO: 405 - protein, 11 aa, Homo sapiens
  VARIANT (2)...(2): Xaa = Ala or Thr
  VARIANT (5)...(5): Xaa = Gly or Thr
  VARIANT (8)...(8): Xaa = Asn or His
  VARIANT (11)...(11): Xaa = Ala or Asn
RXSQXISXYLX

SEQ ID NO: 406 - protein, 7 aa, Homo sapiens
  VARIANT (1)...(1): Xaa = Gly or Ala
  VARIANT (2)...(2): Xaa = Ala or Ile
  VARIANT (4)...(4): Xaa = Thr or Asn
  VARIANT (5)...(5): Xaa = Val or Leu
XXSXXQS

SEQ ID NO: 407 - protein, 9 aa, Homo sapiens
  VARIANT (5)...(5): Xaa = Arg or Ser
  VARIANT (6)...(6): Xaa = Val or Ala
  VARIANT (8)...(8): Xaa = Trp or Tyr
QKYNXXPXT

SEQ ID NO: 408 - protein, 5 aa, Homo sapiens
  VARIANT (1)...(1): Xaa = Lys or Tyr
  VARIANT (3)...(3): Xaa = Asp or Ile
  VARIANT (5)...(5): Xaa = Asp or His
XYXMX

SEQ ID NO: 409 - protein, 17 aa, Homo sapiens
  VARIANT (1)...(1): Xaa = Ser or Gly
  VARIANT (4)...(4): Xaa = Ser or Pro
  VARIANT (8)...(8): Xaa = Leu or Ile
  VARIANT (10)...(10): Xaa = Phe or Val
XISXSGGXTXYADSVKG

SEQ ID NO: 410 - protein, 13 aa, Homo sapiens
HDYDFWSGHAFDI

SEQ ID NO: 411 - protein, 16 aa, Homo sapiens
RGVPAARDYYYYYMDV

SEQ ID NO: 412 - protein, 11 aa, Homo sapiens
  VARIANT (5)...(5): Xaa = Ser or Asn
  VARIANT (7)...(7): Xaa = Ser or Gly
  VARIANT (8)...(8): Xaa = Arg, Asn, Thr or Ser
  VARIANT (9)...(9): Xaa = Tyr or Trp
  VARIANT (10)...(10): Xaa = Leu or Val
  VARIANT (11)...(11): Xaa = Ala or Val
RASQXIXXXXX

SEQ ID NO: 413 - protein, 7 aa, Homo sapiens
  VARIANT (4)...(4): Xaa = Ser, Leu or Thr
  VARIANT (6)...(6): Xaa = Val or Glu
KASXLXS

SEQ ID NO: 414 - protein, 11 aa, Homo sapiens
  VARIANT (1)...(1): Xaa = Gln or Leu
  VARIANT (3)...(3): Xaa = Tyr, Ser, Phe or His
  VARIANT (4)...(4): Xaa = Asn, Gly or Tyr
  VARIANT (5)...(5): Xaa = Asp, Thr or Ser
  VARIANT (6)...(6): Xaa = Tyr or not present
  VARIANT (7)...(7): Xaa = Ser or not present
  VARIANT (8)...(8): Xaa = Pro or not present
  VARIANT (9)...(9): Xaa = Met or not present
  VARIANT (10)...(10): Xaa = Gly, Phe, Lys or Tyr
XQXXXXXXXXT

SEQ ID NO: 415 - protein, 5 aa, Homo sapiens
  VARIANT (1)...(1): Xaa = Tyr, Ala, Asn or Gly
  VARIANT (3)...(3): Xaa = Gly, Arg, Ser or Asn
  VARIANT (5)...(5): Xaa = Gly, Tyr, Ser or Phe
XYXMX

SEQ ID NO: 416 - protein, 17 aa, Homo sapiens
  VARIANT (1)...(1): Xaa = Gly, Ser or Val
  VARIANT (3)...(3): Xaa = Trp, Ser, Arg or Val
  VARIANT (4)...(4): Xaa = Pro or Ser
  VARIANT (8)...(8): Xaa = Pro, Lys, Arg or Leu
  VARIANT (10)...(10): Xaa = Tyr, Thr, Asp or Ser
XIXXSGGXTXYADSVKG

SEQ ID NO: 417 - protein, 11 aa, Homo sapiens
YTGSRTRVFDY

SEQ ID NO: 418 - protein, 12 aa, Homo sapiens
GRGDILTAYFDY

SEQ ID NO: 419 - protein, 7 aa, Homo sapiens
GIAVARY

SEQ ID NO: 420 - protein, 14 aa, Homo sapiens
DIGSSSGDYYGMDV

SEQ ID NO: 421 - protein, 11 aa, Homo sapiens
  VARIANT (5)...(5): Xaa = Gly or Asp
  VARIANT (6)...(6): Xaa = Val or Ile
  VARIANT (7)...(7): Xaa = Ser, Gly, Val or Asn
  VARIANT (8)...(8): Xaa = Thr, Tyr, Ser or Ile
  VARIANT (9)...(9): Xaa = Trp or Tyr
RASQXXXXXLA

SEQ ID NO: 422 - protein, 7 aa, Homo sapiens
  VARIANT (1)...(1): Xaa = Ala, Val or Ser
  VARIANT (2)...(2): Xaa = Ala or Ser
  VARIANT (4)...(4): Xaa = Ser or Thr
  VARIANT (7)...(7): Xaa = Ser or Arg
XXSXLQX

SEQ ID NO: 423 - protein, 9 aa, Homo sapiens
  VARIANT (1)...(1): Xaa = Leu or Gln
  VARIANT (3)...(3): Xaa = Ala, Gly or Ile
  VARIANT (4)...(4): Xaa = Tyr, Lys, Asn or Asp
  VARIANT (5)...(5): Xaa = Asn, Ala, Ser or Thr
  VARIANT (8)...(8): Xaa = Leu, Pro, Phe or Ile
XQXXXFPXT

SEQ ID NO: 424 - protein, 5 aa, Homo sapiens
  VARIANT (1)...(1): Xaa = His, Val, Ala, Gly, Glu or Arg
  VARIANT (3)...(3): Xaa = Val, Phe, Gly, Ser or Ala
  VARIANT (5)...(5): Xaa = Gly, Ser, Glu or Val
XYXMX

SEQ ID NO: 425 - protein, 17 aa, Homo sapiens
  VARIANT (1)...(1): Xaa = Tyr or Arg
  VARIANT (3)...(3): Xaa = Ser, Gly or Tyr
  VARIANT (4)...(4): Xaa = Pro or Ser
  VARIANT (8)...(8): Xaa = Trp, Phe or Tyr
  VARIANT (10)...(10): Xaa = Trp, Ser, Gln, Asn or Ile
  VARIANT (14)...(14): Xaa = Phe or Ser
XIXXSGGXTXYADXVKG

SEQ ID NO: 426 - protein, 12 aa, Homo sapiens
VVRGYYYYGMDV

SEQ ID NO: 427 - protein, 11 aa, Homo sapiens
DIPRGASAFDI

SEQ ID NO: 428 - protein, 8 aa, Homo sapiens
DFGYGMDV

SEQ ID NO: 429 - protein, 8 aa, Homo sapiens
DGSDAFDI

SEQ ID NO: 430 - protein, 7 aa, Homo sapiens
VHDAFDI

SEQ ID NO: 431 - protein, 12 aa, Homo sapiens
  VARIANT (5)...(5): Xaa = Ser, Asn, Gly or Arg
  VARIANT (7)...(7): Xaa = Ser, Asn, Asp or Gly
  VARIANT (8)...(8): Xaa = Ser or not present
  VARIANT (9)...(9): Xaa = Gly, Ser, Phe, Thr, Asn, Ile
  VARIANT (12)...(12): Xaa = His, Asn, Ser or Ala
RASQXIXXXYLX

SEQ ID NO: 432 - protein, 7 aa, Homo sapiens
  VARIANT (1)...(1): Xaa = Ala, Ser or Gly
  VARIANT (2)...(2): Xaa = Thr, Ala or Val
  VARIANT (3)...(3): Xaa = Ser, Asn or Asp
  VARIANT (4)...(4): Xaa = Asn, Ser, Lys, Arg or Thr
  VARIANT (6)...(6): Xaa = His, Asn, Leu, Gln or Glu
  VARIANT (7)...(7): Xaa = Ser, Gly, Asp, Pro or Thr
XXXXLXX

SEQ ID NO: 433 - protein, 10 aa, Homo sapiens
  VARIANT (2)...(2): Xaa = Gln or Glu
  VARIANT (3)...(3): Xaa = Ser, Gly or Thr
  VARIANT (4)...(4): Xaa = Phe, His, Tyr or Asp
  VARIANT (5)...(5): Xaa = Ser, Arg, Ile or Asn
  VARIANT (6)...(6): Xaa = Thr, Ala, Pro, Ser or Ile
  VARIANT (7)...(7): Xaa = Pro, Ser or not present
  VARIANT (8)...(8): Xaa = Pro, Gly, Arg or not present
  VARIANT (9)...(9): Xaa = Leu, Tyr, Phe, Ile, Trp or not present
QXXXXXXXXT

SEQ ID NO: 434 - protein, 5 aa, Homo sapiens
  VARIANT (1)...(1): Xaa = Ala, Leu, Trp, Pro, Asp, Tyr, Ser, Lys, Gly or Arg
  VARIANT (3)...(3): Xaa = Ser, Lys, Val, Thr, Asp, Glu, Gly, Pro, Ala or Trp
  VARIANT (5)...(5): Xaa = Thr, Gly, Met, Glu, Leu, Ile, Val, Gln, Ala or Ser
XYXMX

SEQ ID NO: 435 - protein, 17 aa, Homo sapiens
  VARIANT (1)...(1): Xaa = Gly, Tyr, Ser, Arg or Trp
  VARIANT (3)...(3): Xaa = Tyr, Trp, Ser, Val or Gly
  VARIANT (4)...(4): Xaa = Ser or Pro
  VARIANT (7)...(7): Xaa = Gly or Tyr
  VARIANT (8)...(8): Xaa = Phe, Trp, Gly, Pro, Ala, Leu, Tyr, His, Asn, Thr or Lys
  VARIANT (9)...(9): Xaa = Thr or Ser
  VARIANT (10)...(10): Xaa = Trp, Arg, Gln, His, Lys, Gly, Ile, Tyr or Leu
  VARIANT (11)...(11): Xaa = Tyr or Ala
  VARIANT (12)...(12): Xaa = Ala or Asp
  VARIANT (13)...(13): Xaa = Asp or Ser
  VARIANT (14)...(14): Xaa = Ser or Val
  VARIANT (15)...(15): Xaa = Val or Lys
  VARIANT (16)...(16): Xaa = Lys or Gly
XIXXSGXXXXXXXXXXG

SEQ ID NO: 436 - protein, 10 aa, Homo sapiens
GGYYYDVPYY

SEQ ID NO: 437 - protein, 8 aa, Homo sapiens
ARSACYDD

SEQ ID NO: 438 - protein, 10 aa, Homo sapiens
RHYNKRYFDY

SEQ ID NO: 439 - protein, 8 aa, Homo sapiens
DRDTAMAD

SEQ ID NO: 440 - protein, 9 aa, Homo sapiens
YSLWLGADY

SEQ ID NO: 441 - protein, 17 aa, Homo sapiens
GGYDYVWGSYRPYYFDY

SEQ ID NO: 442 - protein, 18 aa, Homo sapiens
DLGQTIFGVVIGFGGMDV

SEQ ID NO: 443 - protein, 11 aa, Homo sapiens
DRRNYGSYFDY

SEQ ID NO: 444 - protein, 15 aa, Homo sapiens
GPYSSGWSHYVPFDY

SEQ ID NO: 445 - protein, 9 aa, Homo sapiens
HWVSDPFDY

SEQ ID NO: 446 - protein, 13 aa, Homo sapiens
LQVDFWSGYYFDQ

SEQ ID NO: 447 - protein, 10 aa, Homo sapiens
GRLVWNDLDY

SEQ ID NO: 448 - protein, 19 aa, Homo sapiens
DKYYGSGSYPRYYYYYMDV

SEQ ID NO: 449 - protein, 9 aa, Homo sapiens
DRGLYYFDY

SEQ ID NO: 450 - protein, 8 aa, Homo sapiens
VGLWAFDI

SEQ ID NO: 451 - protein, 10 aa, Homo sapiens
AGGYNSPLSY

SEQ ID NO: 452 - protein, 13 aa, Homo sapiens
  VARIANT (3)...(3): Xaa = Ser or Thr
  VARIANT (4)...(4): Xaa = Ser or Leu
  VARIANT (9)...(9): Xaa = Ile, Ser or Thr
  VARIANT (11)...(11): Xaa = Pro, Phe or Ile
  VARIANT (13)...(13): Xaa = Asn, Thr or Ser
SGXXSNIGXNXVX

SEQ ID NO: 453 - protein, 7 aa, Homo sapiens
  VARIANT (1)...(1): Xaa = Asn or Thr
  VARIANT (2)...(2): Xaa = Gln, Asn or Asp
  VARIANT (3)...(3): Xaa = Arg, Asn or His
  VARIANT (4)...(4): Xaa = Pro, Gln or Arg
  VARIANT (5)...(5): Xaa = Ser or Arg
  VARIANT (6)...(6): Xaa = Gly or Pro
  VARIANT (7)...(7): Xaa = Val or Ser
XXXXXXX

SEQ ID NO: 454 - protein, 11 aa, Homo sapiens
  VARIANT (1)...(1): Xaa = Ala or not present
  VARIANT (2)...(2): Xaa = Ala or not present
  VARIANT (6)...(6): Xaa = Ser or Asn
  VARIANT (9)...(9): Xaa = Gly or Cys
  VARIANT (10)...(10): Xaa = Val or Pro
XXWDDXLNXXV

SEQ ID NO: 455 - protein, 5 aa, Homo sapiens
  VARIANT (1)...(1): Xaa = Tyr, Asn or Pro
  VARIANT (3)...(3): Xaa = Pro, Gly or Ala
  VARIANT (5)...(5): Xaa = Val, Ser or Tyr
XYXMX

SEQ ID NO: 456 - protein, 17 aa, Homo sapiens
  VARIANT (1)...(1): Xaa = Arg or Tyr
  VARIANT (3)...(3): Xaa = Ser or Trp
  VARIANT (4)...(4): Xaa = Ser or Pro
  VARIANT (8)...(8): Xaa = Ser, Tyr or Ile
  VARIANT (10)...(10): Xaa = Leu, Lys or Gln
XIXXSGGXTXYADSVKG

SEQ ID NO: 457 - protein, 21 aa, Homo sapiens
GAVVPAAIEWFWSGYSNYFDY

SEQ ID NO: 458 - protein, 11 aa, Homo sapiens
GKGSGSFPLDY

SEQ ID NO: 459 - protein, 15 aa, Homo sapiens
GDFDWLLHHPNAFDI

SEQ ID NO: 460 - protein, 13 aa, Homo sapiens
  VARIANT (3)...(3): Xaa = Ser or Gly
  VARIANT (4)...(4): Xaa = His or Tyr
  VARIANT (7)...(7): Xaa = Ile or Met
  VARIANT (9)...(9): Xaa = Arg or Ser
  VARIANT (12)...(12): Xaa = Val or Ala
  VARIANT (13)...(13): Xaa = Tyr or His
SGXXSNXGXNYXX

SEQ ID NO: 461 - protein, 7 aa, Homo sapiens
  VARIANT (1)...(1): Xaa = Ser or Asn
  VARIANT (4)...(4): Xaa = Glu or Gln
  VARIANT (7)...(7): Xaa = Ala or Ser
XNNXRPX

SEQ ID NO: 462 - protein, 11 aa, Homo sapiens
  VARIANT (2)...(2): Xaa = Thr, Ser or Ala
  VARIANT (8)...(8): Xaa = Ser or Ile
  VARIANT (9)...(9): Xaa = Gly or Ala
  VARIANT (10)...(10): Xaa = Pro or Trp
AXWDDSLXXXV

SEQ ID NO: 463 - protein, 5 aa, Homo sapiens
  VARIANT (1)...(1): Xaa = Ala, Trp or Thr
  VARIANT (3)...(3): Xaa = Pro or Gly
  VARIANT (4)...(4): Xaa = Met or Thr
  VARIANT (5)...(5): Xaa = Arg, Ala or Glu
XYXXX

SEQ ID NO: 464 - protein, 17 aa, Homo sapiens
  VARIANT (1)...(1): Xaa = Tyr, Val or Ser
  VARIANT (3)...(3): Xaa = Tyr or Ser
  VARIANT (8)...(8): Xaa = Pro or Tyr
  VARIANT (10)...(10): Xaa = Tyr, Phe or Gly
XIXPSGGXTXYADSVKG

SEQ ID NO: 465 - protein, 8 aa, Homo sapiens
GVGAPVDS

SEQ ID NO: 466 - protein, 13 aa, Homo sapiens
DSSGWRTAYYFDY

SEQ ID NO: 467 - protein, 13 aa, Homo sapiens
DSLYSSSLDAFDI

SEQ ID NO: 468 - protein, 14 aa, Homo sapiens
  VARIANT (1)...(1): Xaa = Thr or Ser
  VARIANT (10)...(10): Xaa = Tyr or His
  VARIANT (12)...(12): Xaa = Tyr or Phe
XGTSSDVGGXNXVS

SEQ ID NO: 469 - protein, 7 aa, Homo sapiens
  VARIANT (1)...(1): Xaa = Glu or Asp
  VARIANT (3)...(3): Xaa = Ser or Asn
  VARIANT (4)...(4): Xaa = Asn or Lys
XVXXRPS

SEQ ID NO: 470 - protein, 12 aa, Homo sapiens
  VARIANT (1)...(1): Xaa = Ser or Asn
  VARIANT (3)...(3): Xaa = Tyr, Phe or not present
  VARIANT (4)...(4): Xaa = Thr, Arg or not present
  VARIANT (5)...(5): Xaa = Ser or Tyr
  VARIANT (6)...(6): Xaa = Ser, Ala or Thr
  VARIANT (7)...(7): Xaa = Ser, Arg or Ile
  VARIANT (8)...(8): Xaa = Thr or Ser
  VARIANT (9)...(9): Xaa = Leu or Gly
  VARIANT (10)...(10): Xaa = Phe, Asp, Ala or Thr
  VARIANT (11)...(11): Xaa = Tyr or Arg
XSXXXXXXXXXV

SEQ ID NO: 471 - protein, 5 aa, Homo sapiens
  VARIANT (1)...(1): Xaa = Ala, Asp, Phe or Met
  VARIANT (3)...(3): Xaa = Gly, Leu, Trp or Arg
  VARIANT (5)...(5): Xaa = Asp, Thr, Gly or Met
XYXMX

SEQ ID NO: 472 - protein, 17 aa, Homo sapiens
  VARIANT (1)...(1): Xaa = Ser or Gly
  VARIANT (3)...(3): Xaa = Ser, Trp or Arg
  VARIANT (4)...(4): Xaa = Pro or Ser
  VARIANT (8)...(8): Xaa = Gln, Phe, Lys, Met or Arg
  VARIANT (10)...(10): Xaa = Phe, Lys, Gln or Met
XIXXSGGXTXYADSVKG

SEQ ID NO: 473 - protein, 14 aa, Homo sapiens
AKGGDYGDPSPFDY

SEQ ID NO: 474 - protein, 7 aa, Homo sapiens
GIAVARY

SEQ ID NO: 475 - protein, 13 aa, Homo sapiens
GWALFGVVRMGDY

SEQ ID NO: 476 - protein, 14 aa, Homo sapiens
DLGGGYYYYYGMDV

SEQ ID NO: 477 - protein, 11 aa, Homo sapiens
  VARIANT (2)...(2): Xaa = Gly or Ala
  VARIANT (4)...(4): Xaa = Arg, Asn or Lys
  VARIANT (7)...(7): Xaa = Asp or Asn
  VARIANT (8)...(8): Xaa = Lys, Thr or Arg
  VARIANT (10)...(10): Xaa = Ala, Thr or Ile
  VARIANT (11)...(11): Xaa = Ser, Cys or Phe
SXDXLGXXYXX

SEQ ID NO: 478 - protein, 7 aa, Homo sapiens
  VARIANT (1)...(1): Xaa = Gln, Arg or Lys
  VARIANT (2)...(2): Xaa = Asp or Gly
  VARIANT (3)...(3): Xaa = Thr, Asn, Ser, Asp or Arg
XXXKRPS

SEQ ID NO: 479 - protein, 10 aa, Homo sapiens
  VARIANT (1)...(1): Xaa = Gln or His
  VARIANT (2)...(2): Xaa = Ala, Val, Ser or Thr
  VARIANT (3)...(3): Xaa = Trp or Arg
  VARIANT (5)...(5): Xaa = Ser, Arg or Phe
  VARIANT (6)...(6): Xaa = Ser, Thr, Lys, Arg, Gly or Asn
  VARIANT (7)...(7): Xaa = Thr, Tyr, Glu or Ser
  VARIANT (8)...(8): Xaa = Asn, Phe or not present
  VARIANT (9)...(9): Xaa = Val, Trp, Gly, Tyr, Ala or Met
  VARIANT (10)...(10): Xaa = Val or Ile
XXXDXXXXXX

SEQ ID NO: 480 - protein, 5 aa, Homo sapiens
  VARIANT (1)...(1): Xaa = Asp, Arg, Thr, Ile, Lys, Ser, Trp, Tyr or Pro
  VARIANT (3)...(3): Xaa = Phe, Asn, Arg, Lys, Pro, His, Met or Gln
  VARIANT (5)...(5): Xaa = Ala, Val, His, Ile, Gly, Trp, Leu or Tyr
XYXMX

SEQ ID NO: 481 - protein, 17 aa, Homo sapiens
  VARIANT (1)...(1): Xaa = Ser, Gly or Arg
  VARIANT (3)...(3): Xaa = Val, Ser, Tyr, Gly or Arg
  VARIANT (4)...(4): Xaa = Pro or Ser
  VARIANT (8)...(8): Xaa = Trp, Phe, His, Ala, Asn, Lys or Glu
  VARIANT (10)...(10): Xaa = Val, Arg, Gly, Gln, Asp, Tyr, Thr, Phe, Met or Ala
XIXXSGGXTXYADSVKG

SEQ ID NO: 482 - protein, 13 aa, Homo sapiens
WYSSSWYGNWFDP

SEQ ID NO: 483 - protein, 13 aa, Homo sapiens
DEGSNWYSNWFDP

SEQ ID NO: 484 - protein, 17 aa, Homo sapiens
VGWVLRFLEWLPDSFDY

SEQ ID NO: 485 - protein, 22 aa, Homo sapiens
VFPFRDGYNYWFGGDSRDAFDI

SEQ ID NO: 486 - protein, 17 aa, Homo sapiens
GKVVPAAMPYYYYGMDV

SEQ ID NO: 487 - protein, 17 aa, Homo sapiens
DGYDFWSGYPLGYGMDV

SEQ ID NO: 488 - protein, 7 aa, Homo sapiens
DPYGMDV

SEQ ID NO: 489 - protein, 20 aa, Homo sapiens
TPTYYGDFLNGEYYYYGMDV

SEQ ID NO: 490 - protein, 16 aa, Homo sapiens
APRGWESYYYYYGMDV

SEQ ID NO: 491 - protein, 18 aa, Homo sapiens
LNGWSSGWLGYYYYGMDV

SEQ ID NO: 492 - DNA, 325 bp, Homo sapiens
gacatccagatgacccagtctccaggcaccctgtctttgtctccaggggaaagagccaccctctcctgcagggccagtcagagtgttagcagcaggtatttagcctggtaccagcagaaacctggccaggctcccaggctcctcatctatggtgcatccagcagggccactggcatcccagacaggttcagtggcagtgggtctgggacagacttcactctcaccatcagcagactggaggctgaagattttgcagtgtattactgtcagcaatatagtacctcaccgtacacttttggccaggggaccaagctggagatcaaac

SEQ ID NO: 493 - DNA, 349 bp, Homo sapiens
gaagttcaattgttagagtctggtggcggtcttgttcagcctggtggttctttacgtctttcttgcgctgcttccggattcactttctctcgttacggtatgcattgggttcgccaagctcctggtaaaggtttggagtgggtttcttatatcgtttcttctggtggctatactgagtatgctgactccgttaaaggtcgcttcactatctctagagacaactctaagaatactctctacttgcagatgaacagcttaagggctgaggacacagccgtgtattactgtacaacaggaatagcagtggcccgatattggggccagggaaccctggtcaccgtctcaagcg

SEQ ID NO: 494 - DNA, 322 bp, Homo sapiens
gacatccagatgacccagtctccatcctccctgtctgcatctgttggagacagagtcaccatcacttgccgggcaagtcagagcattagcggctatttacattggtatcagcaaaaaccagggaaagcccctaacctcctgatctttgctacatccaatttgcacagtggggtcccatcaaggttcagtggcagtcggtctgggacagatttcactctcaccatcagcagtctgcaacctgaagattttgcaacctacttctgtcagcagagtttcagtacccctccgaccttcggccatgggacacgactggagattaagc

SEQ ID NO: 495 - DNA, 352 bp, Homo sapiens
gaagttcaattgttagagtctggtggcggtcttgttcagcctggtggttctttacgtctttcttgcgctgcttccggattcactttctctgcttactctatgacttgggttcgccaagctcctggtaaaggtttggagtgggtttctggtatctattcttctggtggctttacttggtatgctgactccgttaaaggtcgcttcactatctctagagacaactctaagaatactctctacttgcagatgaacagcttaagggctgaggacacggccgtgtattactgtgccagagtcggcctttgggcttttgatatctggggccaagggacaatggtcaccgtctcaagcg

SEQ ID NO: 496 - DNA, 325 bp, Homo sapiens
gacatccagatgacccagtctccatcctccctgcctgcatctgtaggagacagagtcgccatcacttgccgggcaagtcagagtattagcagcagctatttaaattggtatcagcacaaaccagggaaagcccccaagctcctgatctatgctgcatccaatttgaatagtggggtcccatcaaggttcagtggcagtggatctgggacagatttcactctcactatcagcagtctacagcctgacgattttgcaacttactactgtcaagagagtcacagtgcgtcgctcactttcggcggagggaccaaggtggaggtcaaac

SEQ ID NO: 497 - DNA, 358 bp, Homo sapiens
gaagttcaattgttagagtctggtggcggtcttgttcagcctggtggttctttacgtctttcttgcgctgcttccggattcactttctctctttacaagatgggttgggttcgccaagctcctggtaaaggtttggagtgggtttcttatatctggtcttctggtggctggactcgttatgctgactccgttaaaggtcgcttcactatctctagagacaactctaagaatactctctacttgcagatgaacagcttaagggctgaggatacggccgtgtattactgtgcgagagcgggtggctacaattctcctttgagctactggggccagggcaccctggtcaccgtctcaagcg

SEQ ID NO: 498 - DNA, 337 bp, Homo sapiens
cagtacgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtyagtaatcggccctcaggggtttctaatcgcttctctggctccaagtctggcaacacggcctccctgaccatctctgggctccaggcygaggacgaggctgattattactgcagctcatatacaagcagcagcactctcttytatgtcttcggaacygggaccaaggtcaccgtcctag

SEQ ID NO: 499 - DNA, 370 bp, Homo sapiens
gaagttcaattgttagagtctggtggyggtcttgttcagcctggtggttctttacgtctttcttgcgctgcttccggattcactttctctgcttacggtatggattgggttcgccaagcwcctggtaaaggtttggagtgggtttcttctatctctccttctggtggccagactaagtatgctgactccgttaaaggtcgcttcactatctctagrgacaactctaagaatactctctacttgcagatgaacagcttaagggctgaggacacggccgtgtattactgtgcgaaagaccttgggggggggtactactactactacggtatggacgtctggggccaaggsaccctggtcaccgtctcaagcg

SEQ ID NO: 500 - DNA, 322 bp, Homo sapiens
gacatccagatgacccagtctccaggcaccctgtctgtgtctccaggggaaagagccaccctctcctgcagggccagccagagtgttagtaacaagttagcctggtaccagcagaaacctggccaggctcccaggctcctcatctatggtgcatccaccagggccaccggtatccctgccaggttcagtggcagtgggtctgggacagagttcactctcaccatcaccagcctgcagtctgaagattttgcagtttattactgtcagcagcgtatcaactggccgctcactttcggcggagggaccaaggtcgagatcaaac

SEQ ID NO: 501 - DNA, 373 bp, Homo sapiens
gaagttcaattgttagagtctggtggcggtcttgttcagcctggtggttctttacgtctttcttgcgctgcttccggattcactttctctacttactggatggagtgggttcgccaagctcctggtaaaggtttggagtgggtttcttctatcgtttcttctggtggccctactatgtatgctgactccgttaaaggtcgcttcactatctctagagacaactctaagaatactttctacttgcagatgaacagcttaagggctgaggacacggccgtgtattactgtgcgagagcgcgggagatttcgatttttggagtggttaaagatctcgatatctggggccaggggacaatggtcaccgtctcaagcg

SEQ ID NO: 502 - DNA, 322 bp, Homo sapiens
gacatccagatgacccagtctccatcttccgtgtctgcatctgtaggagacagagtcaccatcacctgtcgggcgagtcagggtgttagcacctggttagcctggtatcagcagaaaccagggaaagcccctaaactcctgatctatgctgcatccagtttgcaaagtggggtcccatcgaggttcagcggcagtgggtctgggacagatttcactctcaccatcagcagcctgcagcctgaagattttgcgacttactattgtctacaggcttacaatttccctctcactttcggcggagggaccgaggtggagatcaaac

SEQ ID NO: 503 - DNA, 349 bp, Homo sapiens
gaagttcaattgttagagtctggtggcggtcttgttcagcctggtggttctttacgtctttcttgcgctgcttccggattcactttctctcattacgttatgggttgggttcgccaagctcctggtaaaggtttggagtgggtttcttatatctctccttctggtggctggacttggtatgctgacttcgttaaaggtcgcttcactatctctagagacaactctaagaatactctctacttgcagatgaacagcttaagggctgaggacacggccgtgtattactgtgcaagagttcatgatgcttttgatatctggggccaagggacaatggtcaccgtctcaagcg

SEQ ID NO: 504 - DNA, 319 bp, Homo sapiens
cagagcgctttgactcagccaccctcagtgtccgtgtccccaggacagacagccagcatcacctgctctggagatagattgggggataaatatgcttcctggtatcagcagaagccaggccagtcccctgtgttggtcatctatcaagataccaagcggccctcagggatccctgagcgattctctggctccaactctgggtccacagccactctgaccatcagcgggacccaggctatggatgaggctgactattactgtcaggcgtgggacagcagcactgtggtattcggcggagggaccaagctgaccgtcctag

SEQ ID NO: 505 - DNA, 382 bp, Homo sapiens
gaagttcaattgttagagtctggtggcggtcttgttcagcctggtggttctttacgtctttcttgcgctgcttccggattcactttctctgattactttatggcttgggttcgccaagctcctggtaaaggtttggagtgggtttcttctatcgttccttctggtggctggactgtttatgctgactccgttaaaggtcgcttcactatctctagagacaactctaagaatactctctacttgcagatgaacagcttaagggctgaggacacggccgtgtattactgtgcgagattaaatgggtggagcagtggctggttaggttactactactacggtatggacgtctggggccaagggaccacggtcaccgtctcaagcg

SEQ ID NO: 506 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactcgatcaccttcggccaagggacacgactggagattaaac

SEQ ID NO: 507 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagcg

SEQ ID NO: 508 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggttcctgcagaagccagggcagtctccacagctcctgatctatttgggttctcatcgggcctccggggtccctgacaggttcagtggcagtggatcaggcacagattttacactgaaaatcagcagagtggaggctgaagatgttggggtttattactgcatgcaagctctacaaagtcgctacacttttggccaggggaccaagctggagatcaaac

SEQ ID NO: 509 - DNA, 355 bp, Homo sapiens
gaagttcaattgttagagtctggtggcggtcttgttcagcctggtggttctttacgtctttcttgcgctgcttccggattcactttctcttggtacggtatggtttgggttcgccaagctcctggtaaaggtttggagtgggtttcttctatctctccttctggtggctctactgattatgctgactccgttaaaggtcgcttcactatctctagagacaactctaagaatactctctacttgcagatgaacagcttaagggctgaggacacggccgtgtattactgtgcgagagtgggcagcagctggtacctggacgtctggggccaagggaccacggtcaccgtctcaagcg

SEQ ID NO: 510 - DNA, 337 bp, Homo sapiens
cagagcgaattgactcagcctcgctcagtgtccgggtctcctggacagtcagtcaccatctcctgcactggaaccagcagtgacgttggtggttataactatgtctcctggtaccgacaagacccaggcaaagcccccaaactcatcatttatgaggtcagtaagcggccctcgggggtgtctaatcgcttctctggctccaagtctggcaacacggcctccctgaccatctctgggctccacattgaggacgaaggtctttattattgcagttcatttagatacagcagaagtctcgattatgtcttcggaactgggacccaggtcaccgtcctgg

SEQ ID NO: 511 - DNA, 370 bp, Homo sapiens
gaagttcaattgttagagtctggtggcggtcttgttcagcctggtggttctttacgtctttcttgcgctgcttccggattcactttctctgattaccttatgacttgggttcgccaagctcctggtaaaggtttggagtgggtttctggtatctggccttctggtggctttactttttatgctgactccgttaaaggtcgcttcactatctctagagacaactctaagaatactctctacttgcagatgaacagcttaagggctgaggacacggccgtgtattactgtgcgagagctaaggggggtgactacggtgaccccagcccttttgactactggggccagggaaccctggtcaccgtctcaagcg

SEQ ID NO: 512 - DNA, 322 bp, Homo sapiens
gacatccagatgacccagtctccatcttctgtgtctgcatctgtaggagacagagtcaccatcacttgccgggcgagtcaggggattggctactggttagcctggtatcagcagaaaccagggaactcccctaaactcctgatctatgtttcatccactttgcagcgtggggtcccatcaaggttcagcggcaggggatctgggacagatttcactctcactatcaacaacctgcagcctgaagattttgcaacttattattgtcaacaggctaaagctttcccgctcactttcggcggggggaccaaggtggagatcaacc

SEQ ID NO: 513 - DNA, 364 bp, Homo sapiens
gaagttcaattgttagagtctggtggcggtcttgttcagcctggtggttctttacgtctttcttgcgctgcttccggattcactttctctgtttactttatgtcttgggttcgccaagctcctggtaaaggtttggagtgggtttcttatatcggtccttctggtggctttacttcttatgctgactccgttaaaggtcgcttcactatctctagagacaactctaagaatactctctacttgcagatgaacagcttaagggctgaggacacggccgtgtattactgtgcgagagttgtacgcggatactactactacggtatggacgtctggggccaagggaccacggtcaccgtctcaagcg

SEQ ID NO: 514 - DNA, 337 bp, Homo sapiens
gacatccagatgacccagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgatcaccttcggccaagggacacgactggagattaaac

SEQ ID NO: 515 - DNA, 373 bp, Homo sapiens
gaagttcaattgttagagtctggtggcggtcttgttcagcctggtggttctttacgtctttcttgcgctgcttccggattcactttctctcgttacgctatgtggtgggttcgccaagctcctggtaaaggtttggagtgggtttctggtatcgttccttctggtggccttactacttatgctgactccgttaaaggtcgcttcactatctctagagacaactctaagaatactctctacttgcagatgaacagcttaagggctgaggacacggccgtgtattactgtgcgagacatgaggtttccgagcagtggctgttcccggggaactttgactactggggccagggaaccctggtcaccgtctcaagcg

SEQ ID NO: 516 - DNA, 325 bp, Homo sapiens
cagagcgtcttgactcagccaccctcagcgtctgggacccccggacagagggtcaccatctcttgttctggaagcagctccaacatcggaatcaatcctgtaaactggtaccagcagttcccaggaacggcccccaaactcctcatctataatcagcggccctcaggggtccctgaccgattctctggctccaagtctggcacctcagcctccctggccatcagtgggctccagtctgaggatgaggctgattattactgtgcagcatgggatgacagcctgaatggtgtggtattcggcggagggaccaagctgaccgtcctag

SEQ ID NO: 517 - DNA, 391 bp, Homo sapiens
gaagttcaattgttagagtctggtggcggtcttgttcagcctggtggttctttacgtctttcttgcgctgcttccggattcactttctcttattaccctatggtttgggttcgccaagctcctggtaaaggtttggagtgggtttctcgtatctcttcttctggtggctctactctttatgctgactccgttaaaggtcgcttcactatctctagagacaactctaagaatactctctacttgcagatgaacagcttaagggctgaggacacggccgtgtattactgtgcgagaggtgcagtagtaccagctgccattgagtggttttggagtggttactctaactactttgactactggggccagggcaccctggtcaccgtctcaagcg

SEQ ID NO: 518 - DNA, 322 bp, Homo sapiens
gacatccagatgacccagtctccatcctccctgtctgcatctgtkggagacagagtcaccatcacttgccgggcaagtcagaacattaacttttatttaagttggtttcagcagaagccagggaaggcccctaagctcctgatccactctgtaaacaatttgctcggtccggtcccatcaaggttcagtggcagtggatctgggacagatttcactctcaccatcgtcagtctacaacctgaggactttgctacttattactgtcaacagggttaccgtcccccctacacttttggccaggggaccaagctggagatcaaag

SEQ ID NO: 519 - DNA, 358 bp, Homo sapiens
gaagttcaattgttagagtctggtggcggtcttgttcagcctggtggttctttacgtctttcttgcgcygcttccggattcactttctcttggtacgttatgatgtgggttcgccaagctcctggtaaaggtttggagtgggtttctggtatctcttcttctggtggcggtactcagtatgctgactccgttaaaggtcgcttcactatctctagagacaactctaagaatactctctacttgcagatgaacagcttaagggctgaggacacggctgtgtattactgtgcgagagggggatattactatgatgttccctactactggggccagggcaccctggtcaccgtctcaagcg

SEQ ID NO: 520 - DNA, 337 bp, Homo sapiens
gacatccagatgacccagtctccactctccctgcccgtcactcctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccatcaccttcggccaagggacacgactggagattaaac

SEQ ID NO: 521 - DNA, 358 bp, Homo sapiens
gaagttcaattgttagagtctggtggcggtcttgttcagcctggtggttctttacgtctttcttgcgctgcttccggattcactttctcttggtacgttatgatgtgggttcgccaagctcctggtaaaggtttggagtgggtttctggtatctcttcttctggtggcggtactcagtatgctgactccgttaaaggtcgcttcactatctctagagacaactctaagaatactctctacttgcagatgaacagcttaagggctgaggacacggctgtgtattactgtgcgagagggggatattactatgatgttccctactactggggccagggcaccctggtcaccgtctcaagcg

SEQ ID NO: 522 - DNA, 322 bp, Homo sapiens
agacatccaatgacccagtctccactctccctgtctgcatctgtaggagacagagtcaccgtcacttgccgggcaagtcagagcattagcacctatttaaattggtatcaacagaaaccagggaaagcccctaagctcctgatctatgctgcatccagtttgcaaagtggggtcccatcaaggttcagtggcagtggatctgggacagatttcactctcaccatcagaagtctgcagcctgatgattttgcaacttactactgtcagcagagttacagttccccattcactttcggccctgggaccaaagtggatttcaaac

SEQ ID NO: 523 - DNA, 352 bp, Homo sapiens
gaagttcaattgttagagtctggtggcggtcttgttcagcctggtggttctttacgtctttcttgcgctgcttccggattcactttctctccttacactatggagtgggttcgccaagctcctggtaaaggtttggagtgggtttcttctatctatccttctggtggctggactcattatgctgactccgttaaaggtcgcttcactatctctagagacaactctaagaatactctctacttgcagatgaacagcttaagggctgaggacaccgccatgtattactgtgcgagagctcgtagtgcctgctatgacgactggggccagggaaccctggtcaccgtctcaagcg

SEQ ID NO: 524 - DNA, 337 bp, Homo sapiens
gacatccagatgacccagtctccatcctccctgcccgtcacccctggagagccggcctccatctcctgcaggtctagtcagagcctcctgcatactaatggacacaactatttggattggtacctgcagaagccagggcagtctccaaagctcctgatctatttgggttctaatcgggcctccggggtccctgacaggttcagtggcagtggatcaggcacagattttacactgaaaatcagcagagtggaggctgaggatgttgggctttattactgcatgcagggtctacaaattccgctcacctttggcggagggaccaaggtggagatcaaac

SEQ ID NO: 525 - DNA, 358 bp, Homo sapiens
gaagttcaattgttagagtctggtggcggtcttgttcagcctggtggttctttacgtctttcttgcgctgcttccggattcactttctctgcttacgttatgctttgggttcgccaagctcctggtaaaggtttggagtgggtttcttatatctggccttctggtggcgagactaagtatgctgactccgttaaaggtcgcttcactatctctagagacaactctaagaatactctctacttgcagatgaacagcttaagggctgaggacacggccgtatattactgtgcgagatcaatgggctatggtgatgcttttgatatctggggccaagggacaatggtcaccgtctcaagcg

SEQ ID NO: 526 - DNA, 322 bp, Homo sapiens
gacatccagatgacccagtctccatcctccctgtctgcatctgtaggagacagagtcaccatcacttgccggtcaagtcagggcgttagatatgatttaggctggtatcagcagaaaccagggaaagcccctaaactcctgatctatggtgcattcaatttacaaggtggggtcccttcaaggttcagcggcagtggatctggcacagatttcactctcaccatcagcggcctgcagcctgaagactttgcaacttattattgtctacaagacttccaatacccatttactttcggccctgggaccaaagtcgatgtcaaac

SEQ ID NO: 527 - DNA, 361 bp, Homo sapiens
gaagttcaattgttagagtctggtggcggtcttgttcagcctggtggttctttacgtctttcttgcgctgcttccggattcactttctctggttacgatatgtcttgggttcgccaagctcctggtaaaggtttggagtgggtttcttctatctggtcttctggtggctatactaagtatgctgactccgttaaaggtcgcttcactatctctagagacaactctaagaatactctctacttgcagatgaacagcttaagggctgaggacacggccgtgtattactgtgctagacaaggagtaggtggttcggggagtttgctctactggggccagggaaccctggtcaccgtctcaagcg

SEQ ID NO: 528 - DNA, 319 bp, Homo sapiens
gacatccagatgacccagtctccatcctccctgtctgcatctgtaggagacagagtcaccgtcacttgccgggcaagtcagagcatcagcagctatttaaattggtatcagcagaaaccagggaaagcccctgacctcctgatctatgctgcatccagtttgcaaagtggggtcccatcaaggttcagtggcagtggatctgggacagatttcactctcaccatcagcagtctgcaacctgaagattttgtaacttactactgtcaagagacttacagtgccctcactttcggcggagggaccaaggtggagatcaaac

SEQ ID NO: 529 - DNA, 358 bp, Homo sapiens
gaagttcaattgttagagtctggtggcggtcttgttcagcctggtggttctttacgtctttcttgcgctgcttccggattcactttctctgattactctatgctttgggttcgccaagctcctggtaaaggtttggagtgggtttcttatatctcttcttctggtggccctactaagtatgctgactccgttaaaggtcgcttcactatctctagagacaactctaagaatactctctacttgcagatgaacagcttaagggctgaggacaccgccatgtattactgtgcgagacgccactacaataaacggtactttgactactggggccagggaaccctggtcaccgtctcaagcg

SEQ ID NO: 530 - DNA, 322 bp, Homo sapiens
cagagcgctttgactcagccaccctcagtgtccgtgtccccaggacagacagccagcatcacctgctctggagataacttgggggataaatatgcttcctggtatcaacaaaagccaggccagtcccctgtgctggtcatctatcaagataacaagcggccctcagggatccctgaacgattctctggctccaactctgggaacacagccactctgaccctcagcagggtcgaagccggggatgaggccgactattactgtcaggtgtgggacagtagttataattgggtgttcggcggagggaccaagctgaccgtcctag

SEQ ID NO: 531 - DNA, 367 bp, Homo sapiens
gaagttcaattgttagagtctggtggcggtcttgttcagcctggtggttctttacgtctttcttgcgctgcttccggattcactttctctcgttacaatatggtttgggttcgccaagctcctggtaaaggtttggagtgggtttcttctatctcttcttctggtggctttactcgttatgctgactccgttaaaggtcgcttcactatctctagagacaactctaagaatactctctacttgcagatgaacagcttaagggctgaggacacggccgtgtattactgtgcgagatggtatagcagcagctggtacggaaactggttcgacccctggggccagggcaccctggtcaccgtctcaagcg

SEQ ID NO: 532 - DNA, 322 bp, Homo sapiens
gacatccagatgacccagtctccaggcaccctgtctttgtctccaggggaaagagccaccctctcctgcagggccagtcagagtgttagcagctacttagcctggtaccaacagaaacctggccaggctcccaggctcctcatctttgatgcatccaacagggccactggcatcccagccaggttcagtggcgctgggtctgggacagacttcactctcaccatcagcagcctagagccagaagattttgcagtttattactgtcagcagcgtagcaactggccttggacgttcggccaagggaccaaggtggaaatcaaac

SEQ ID NO: 533 - DNA, 364 bp, Homo sapiens
gaagttcaattgttagagtctggtggcggtcttgttcagcctggtggttctttacgtctttcttgcgctgcttccggattcactttctctaagtactggatggcttgggttcgccaagctcctggtaaaggtttggagtgggtctcttatatctctccttctggtggctggactcgttatgctgactccgttaaaggtcgcttcactatctctagagacaactctaagaatactctctacttgcagatgaacagcttacgggctgaggacacggccgtgtattactgtgcgagagttggagggagctactccctcggtgctcttgatatctggggccaagggacaatggtcaccgtctcaagcg

SEQ ID NO: 534 - DNA, 322 bp, Homo sapiens
gacatccagatgacccagtctccatcctccctgtctgcatctgtaggagacagagtcaccatcacttgtcgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaac

SEQ ID NO: 535 - DNA, 352 bp, Homo sapiens
gaagttcaattgttagagtctggtggcggtcttgttcagcctggtggttctttacgtctttcttgcgctgcttccggattcactttctcttattacactatgggttgggttcgccaagctcctggtaaaggtttggagtgggtttcttctatctggccttctggtggcgctacttggtatgctgactccgttaaaggtcgcttcactatctctagagacaactctaagaatactctctacttgcagatgaacagcttaagggctgaggacacagccacgtattactgtgcgagagaccgagatacagctatggccgactggggccagggaaccctggtcaccgtctcaagcg

SEQ ID NO: 536 - DNA, 331 bp, Homo sapiens
cagagcgaattgactcagccaccctcagcgtccggtatccccgggcagagggtcaccatctcttgttctggaagccactccaacatcggaaggaattatgtatactggtatcagcaactcccaggaacggcccccaaactcctcatctacagtaataatgagcgacccgcaggggtccctgaccgattctctggctccaagtctggcacctcagcctccctggccatcagtgggctccggtccgaggatgaagttgattattactgtgctacgtgggatgacagcctgagtggtccggtgttcggcggagggaccaagctgaccgtcctcg

SEQ ID NO: 537 - DNA, 352 bp, Homo sapiens
gaagttcaattgttagagtctggtggcggtcttgttcagcctggtggttctttacgtctttcttgcgctgcttccggattcactttctctgcttaccctatgcgttgggttcgccaagctcctggtaaaggtttggagtgggtttcttatatctatccttctggtggccctacttattatgctgactccgttaaaggtcgcttcactatctctagagacaactctaagaatactctctacttgcagatgaacagcttaagggctgaggacacggccgtgtattactgtgctcagggggtgggagctcccgttgactcctggggccagggaaccctggtcaccgtctcaagcg

SEQ ID NO: 538 - DNA, 331 bp, Homo sapiens
cagagcgaattgactcagccaccctcagcgtccggtatccccgggcagagggtcaccatctcttgttctggaagccactccaacatcggaaggaattatgtatactggtatcagcaactcccaggaacggcccccaaactcctcatctacagtaataatgagcgacccgcaggggtccctgaccgattctctggctccaagtctggcacctcagcctccctggacgtcagtgggctccagtctgaggatgaggctgattattactgtgcatcatgggatgacagcctgattgcttgggtgttcggcggagggaccatgctgaccgtcctag

SEQ ID NO: 539 - DNA, 367 bp, Homo sapiens
gaagttcaattgttagagtctggtggcggtcttgttcagcctggtggttctttacgtctttcttgcgctgcttccggattcactttctcttggtacggtacggcttgggttcgccaagctcctggtaaaggtttggagtgggtttctgttatctctccttctggtggccctactttttatgctgactccgttaaaggtcgcttcactatctctagagacaactctaagaatactctctacttgcagatgaacagcttaagggctgaggacatggctgtgtattactgtgcgagagatagcagtggctggcgaactgcgtactactttgactactggggccagggaaccctggtcaccgtctcaagcg

SEQ ID NO: 540 - DNA, 331 bp, Homo sapiens
cagagcgctttgactcagccaccctcagcgtctgggacccccgggcagagggtcaccatctcttgttctggaggctactccaacatgggaagcaattatgcacactggtaccagcagctcccaggaacggcccccaaactcctcatctataacaataatcagcggccctcaggggtccctgaccgattctctggctccaagtctggcacctcagcctccctggccatcagtgggctccggtccgaggatgaggctgattattactgtgcagcatgggatgacagcctgagtggtccggtgttcggcggagggaccaagctgaccgtcctag

SEQ ID NO: 541 - DNA, 367 bp, Homo sapiens
gaagttcaattgttagagtctggtggcggtcttgttcagcctggtggttctttacgtctttcttgcgctgcttccggattcactttctctacttacggtatggagtgggttcgccaagctcctggtaaaggtttggagtgggtttcttctatctctccttctggtggctatactggttatgctgactccgttaaaggtcgcttcactatctctagagacaactctaagaatactctctacttgcagatgaacagcttaagggctgaggacacggccgtgtattactgtgcgaaagattccctgtatagcagcagcctagatgcttttgatatctggggccaagggacaatggtcaccgtctcaagcg

SEQ ID NO: 542 - DNA, 325 bp, Homo sapiens
gacatccagatgacccagtctccatcttccctgtctgcatctgtgggagacagagtcgccatcacttgccgcgcaagtcagagcatcgacacctatttaaattggtatcagcagaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaac

SEQ ID NO: 543 - DNA, 355 bp, Homo sapiens
gaagttcaattgttagagtctggtggcggtcttgttcagcctggtggttctttacgtctttcttgcgctgcttccggattcactttctcttcttacgatatgatttgggttcgccaagctcctggtaaaggtttggagtgggtttctcgtatcgttccttctggtggccttactggttatgctgactccgttaaaggtcgcttcactatctctagagacaactctaagaatactctctacttgcagatgaacagcttaagggctgaggacacggccgtgtattactgtgcgaggtattccctatggttaggggctgactactggggccagggaaccctggtcaccgtctcaagcg

SEQ ID NO: 544 - DNA, 322 bp, Homo sapiens
gacatccagatgacccagtctccttccaccctgtctgcatctgtaggagacagagtcaccctcacttgccgggccagtcagagtattagtaggtacttggcctggtatcagcagaaaccagggaaagcccctaaactcttaatctataaggcttctagtttagtaagtgggttcccatcaaggttcagcggcagtggatctgggacagaattcactctcaccatcagcagcctgcagcctgatgattctgcaacttattactgccaacagtataatgattatccggggacttttggccaggggaccaagctggagatcaagc

SEQ ID NO: 545 - DNA, 361 bp, Homo sapiens
gaagttcaattgttagagtctggtggcggtcttgttcagcctggtggttctttacgtctttcttgcgctgcttccggattcactttctcttattacggtatgggttgggttcgccaagctcctggtaaaggtttggagtgggtttctggtatctggccttctggtggccctacttattatgctgactccgttaaaggtcgcttcactatctctagagacaactctaagaatactctctacttgcagatgaacagcttaagggctgaggacaccgccatgtattactgtgcgaagtatactgggagtcgaactagggtttttgactattggggccagggaaccctggtcaccgtctcaagcg

SEQ ID NO: 546 - DNA, 322 bp, Homo sapiens
gacatccagatgacccagtctccatccttcctgtctgcatctgtaggagacagagtcaccatcacttgccgggccagtcagggctttggcagttatttagcctggtatcagcaaaaaccagggaaagcccctaagctcctgatctacgctgcatccactttgcaaagtggggtcccatcaaggttcagcggcagtggatctgggacagaattcactctcacaatcagcagcctgcagcctgaagattttgcaacttattactgtcaacaccttaatagtttccgattcactttcggccctgggaccaaagtggatatcaaac

SEQ ID NO: 547 - DNA, 361 bp, Homo sapiens
gaagttcaattgttagagtctggtggcggtcttgttcagcctggtggttctttacgtctttcttgcgctgcttccggattcactttctcttattacgagatggtttgggttcgccaagctcctggtaaaggtttggagtgggtttctcgtatctggccttctggtggctatactcgttatgctgactccgttaaaggtcgcttcactatctctagagacaactctaagaatactctctacttgcagatgaacagcttaagggctgaggacacggccgtgtattactgtgcgagaggagtcctaactgatcccggggcttttgatatctggggccaagggacaatggtcaccgtctcaagcg

SEQ ID NO: 548 - DNA, 322 bp, Homo sapiens
gacatccagatgacccagtctccatcctccctgtctgcatctgttggagacagagtcaccatcacttgccgggcaagtcagaacattaacttttatttaagttggtttcagcagaagccagggaaggcccctaagctcctgatccactctgtaaacaatttgctcggtccggtcccatcaaggttcagtggcagtggatctgggacagatttcactctcaccatcgtcagtctacaacctgaggactttgctacttattactgtcaacagggttaccgtcccccctacacttttggccaggggaccaagctggagatcaaag

SEQ ID NO: 549 - DNA, 379 bp, Homo sapiens
gaagttcaattgttagagtctggtggcggtcttgttcagcctggtggttctttacgtctttcttgcgctgcttccggattcactttctcttattacgagatggtttgggttcgccaagctcctggtaaaggtttggagtgggtttctcgtatctggccttctggtggctatactcgttatgctgactccgttaaaggtcgcttcactatctctagagacaactctaagaatactctctacttgcagatgaacagcttaagggctgaggacacggccgtgtattactgtgcgagaggagggtatgattacgtttgggggagttatcgtccgtactactttgactactggggccagggaaccctggtcaccgtctcaagcg

SEQ ID NO: 550 - DNA, 319 bp, Homo sapiens
cagagcgtcttgactcagccaccctcagtgtccgtgaccccaggacagacagccattctctcctgctctggagataagttgggcgatacatatgcatcctggtttcaacagaagccaggccagtcccctgtcatggtcatgtatcgcggcaataagcggccctcagggatccctgagcggttctctggctccagctctgggaacacagccactctgaccatcagcgggacccaggctgtggatgaggctgactattactgtcaggcgtgggacaggaccacgggggtcttcggaactgggaccagactgaccgtcctac

SEQ ID NO: 551 - DNA, 367 bp, Homo sapiens
gaagttcaattgttagagtctggtggcggtcttgttcagcctggtggttctttacgtctttcttgcgctgcttccggattcactttctctacttaccgtatggtttgggttcgccaagctcctggtaaaggtttggagtgggtttcttctatctatccttctggtggccatactggttatgctgactccgttaaaggtcgcttcactatctctagagacaactctaagaatactctctacttgcagatgaacagcttaagggctgaggacacggctgtgtattactgtgcgagagatgaaggcagcaactggtactcgaactggttcgacccctggggccagggaaccctggtcaccgtctcaagcg

SEQ ID NO: 552 - DNA, 325 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtacacttttggccaggggaccaagctggagatcaaac

SEQ ID NO: 553 - DNA, 382 bp, Homo sapiens
gaagttcaattgttagagtctggtggcggtcttgttcagcctggtggttctttacgtctttcttgcgctgcttccggattcactttctctaagtacactatgcagtgggttcgccaagctcctggtaaaggtttggagtgggtttctcgtatctcttcttctggtggcgctactcgttatgctgactccgttaaaggtcgcttcactatctctagagacaactctaagaatactctctacttgcagatgaacagcttaagggctgaggacactgcagtctactattgtgcgagagatcttgggcaaacgatttttggagtggttattggattcggaggtatggacgtctggggccaagggaccacggtcaccgtctcaagcg

SEQ ID NO: 554 - DNA, 325 bp, Homo sapiens
gacatccagatgacccagtctccatcctccctgtctgcatctgtgggagacagagtcgccatcacttgccgcgcaagtcagagcatcgacacctatttaaattggtatcagcagaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaac

SEQ ID NO: 555 - DNA, 361 bp, Homo sapiens
gaagttcaattgttagagtctggtggcggtcttgttcagcctggtggttctttacgtctttcttgcgctgcttccggattcactttctcttcttacggtatgggttgggttcgccaagctcctggtaaaggtttggagtgggtttcttggatctatccttctggtggccatactatttatgctgactccgttaaaggtcgcttcactatctctagagacaactctaagaatactctctacttgcagatgaacagcttaagggctgaggacacagccacatattactgtgcgaaagatcggcggaactatggttcctactttgactactggggccagggaaccctggtcaccgtctcaagcg

SEQ ID NO: 556 - DNA, 331 bp, Homo sapiens
cagagcgctttgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatgcaagcagcggcgctcgagtcttcggaactgggaccaaggtcaccgtcctag

SEQ ID NO: 557 - DNA, 349 bp, Homo sapiens
gaagttcaattgttagagtctggtggcggtcttgttcagcctggtggttctttacgtctttcttgcgctgcttccggattcactttctctttttactggatgggttgggttcgccaagctcctggtaaaggtttggagtgggtttcttctatctcttcttctggtggcaagactcagtatgctgactccgttaaaggtcgcttcactatctctagagacaactctaagaatactctctacttgcagatgaacagcttaagggctgaggacacggccgtgtattactgtgcaacaggaatagcagtggcccgatattggggccagggaaccctggtcaccgtctcaagcg

SEQ ID NO: 558 - DNA, 337 bp, Homo sapiens
gacatcgtcatgactcaaacccctcctagtttaccggttaacccgggtgaacctgcctccatctcttgcaggtctagtcagagcctccaacatagtaatggatacaactatgtggcttggtacctgcagaagccagggcagtctccacaactcctgatctatttgggttctaatcgggcctccggggtccctgacaggttcagtggcagtggatcaggcacagatttcaagctgaaaatcagcagagtggaggctgaagatgttggggattatttctgcatgcagcttctagaaactccgctcactttcggaggagggaccaaggtggagatcaaac

SEQ ID NO: 559 - DNA, 355 bp, Homo sapiens
gaagttcaattgttagagtctggtggcggtcttgttcagcctggtggttctttacgtctttcttgcgctgcttccggattcactttctctcagtacggtatgcgttgggttcgccaagctcctggtaaaggtttggagtgggtttcttctatcggtccttctggtggctttactcgttatgctgactccgttaaaggtcgcttcactatctctagagacaactctaagaatactttctacttgcagatgaacagcttaagggctgaggacacggccgtgtattactgtgcgaggagtggttcgacctggtacttcgatctctggggccgtggcaccctggtcaccgtctcaagcg

SEQ ID NO: 560 - DNA, 322 bp, Homo sapiens
gacatccagatgacccagtctccatcctccctgtctgcatctgtaggagacagagtcaccatcacttgccgggcgagtcagggcattagcaattacttagcctggtatcagcagaaaccagggaaagtccctaagctcctgatctatggtgcatccactgtgcaatcaggggtcccatctcgattcagtggcagtggatctgggacagatttcactctcaccatcagcagcctgcagcctgaagatgttgcaacttattactgtcaaaaatataaccgtgtcccgtggacgttcggccaagggaccaaggtggaaatcaaac

SEQ ID NO: 561 - DNA, 367 bp, Homo sapiens
gaagttcaattgttagagtctggtggcggtcttgttcagcctggtggttctttacgtctttcttgcgctgcttccggattcactttctctaagtacgatatggattgggttcgccaagctcctggtaaaggtttggagtgggtttcttctatctcttcttctggtggccttactttttatgctgactccgttaaaggtcgcttcactatctctagagacaactctaagaatactctctacttgcagatgaacagcttaagggctgaggacacggccgtgtattactgtgcgagacatgattacgatttttggagtggtcatgcttttgatatctggggccaagggacaatggtcaccgtctcaagcg

SEQ ID NO: 562 - DNA, 337 bp, Homo sapiens
gacatccagatgacccagtctccactctccctgcccgtcacccctggagagccggcctccatctcctgcaggtctagtcagagcctcctgcataggaacggatacaactatttggattggtacgtgcagaggccagggcagtctcctcagctcctgatctatttgggttctaatcgggcctccggggtccctgacaggttcagtggcagtggatcaggcacagattttacactgagaattagcagagtggaggctgaggatgttggggtttactactgcatggaagctctacaaactcctcccactttcggcggagggaccaaggtggagatcaaac

SEQ ID NO: 563 - DNA, 367 bp, Homo sapiens
gaagttcaattgttagagtctggtggcggtcttgttcagcctggtggttctttacgtctttcttgcgctgcttccggattcactttctctaagtacggtatgaattgggttcgccaagctcctggtaaaggtttggagtgggtttctggtatcgtttcttctggtggccagactccttatgctgactccgttaaaggtcgcttcactatctctagagacaactctaagaatactctctacttgcagatgaacagcttaagggctgaggacacggctgtgtattactgtgcgagaggggtaagaggctacggtgactactggtacttcgatctctggggccgtggcaccctggtcaccgtctcaagcg

SEQ ID NO: 564 - DNA, 337 bp, Homo sapiens
gacatccagatgacccagtctccactctccctgcccgtcacccctggagagccggcctccatctcctgcaggtctagtcagagcctcctggaaagtaatggatacaactatttggattggtacctgcagaagccagggcagtctccacagctcctgatctatttgggttctaatcgggcctccggggtccctgacaggttcagtggcagtggatcaggcacagatttcacactgaaaatcagcagagtggaggctgaggatgttggggtttattactgcatgcaagctcgacaaactccgcttactttcggcggagggaccaaggtggagatcaaac

SEQ ID NO: 565 - DNA, 355 bp, Homo sapiens
gaagttcaattgttagagtctggtggcggtcttgttcagcctggtggttctttacgtctttcttgcgctgcttccggattcactttctctatgtacggtatgctttgggttcgccaagctcctggtaaaggtttggagtgggtttcttatatcggtccttctggtggcgctactcattatgctgactccgttaaaggtcgcttcactatctctagagacaactctaagaatactctctacttgcagatgaacagcttaagggctgaggacacggccgtgtattactgtgcgagaggagggcccggctggtacttcgatctctggggccgtggaaccctggtcaccgtctcaagcg

SEQ ID NO: 566 - DNA, 322 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatgtatgctgcgtccagtttgcaaagtggggtcccatccaggttcagtggcagtggatctgggacagatttcactctcaccatcagcagtctgcaacctgaagattttgcaacttactactgtcaacagagttatagtacccctcctactttcggccaagggaccaaggtggaaatcaaac

SEQ ID NO: 567 - DNA, 373 bp, Homo sapiens
gaagttcaattgttagagtctggtggcggtcttgttcagcctggtggttctttacgtctttcttgcgctgcttccggattcactttctctgcttaccctatggcttgggttcgccaagctcctggtaaaggtttggagtgggtttcttctatctctccttctggtggcaatactcagtatgctgactccgttaaaggtcgcttcactatctctagagacaactctaagaatactctctacttgcagatgaacagcttaagggctgaggacacggccgtgtattactgtgcgagaggaccgtatagcagtggctggtcccattacgtaccctttgactactggggccagggcaccctggtcaccgtctcaagcg

SEQ ID NO: 568 - DNA, 322 bp, Homo sapiens
gacatccagatgacccagtctccatcctccctgtctgcatctgtaggagacagagtcaccatcacttgtcgggcgagtcagggtattagcaactacttagcctggtatcagcagagaccagggaaagcccctaagctcctgatctatgctgcgtccagtttgcaaagtggggtcccatcaaggttcagtggcagtggatctgggacagatttcactctcaccatcagcagtctacaacctggagattttgcaacttactactgtcaacagagttacagtatcccgtacacttttggccaggggaccaagctggagatcaaac

SEQ ID NO: 569 - DNA, 355 bp, Homo sapiens
gaagttcaattgttagagtctggtggcggtcttgttcagcctggtggttctttacgtctttcttgcgctgcttccggattcactttctctggttacgctatgggttgggttcgccaagctcctggtaaaggtttggagtgggtttcttatatcggtccttctggtggctggactcgttatgctgactccgttaaaggtcgcttcactatctctagagacaactctaagaatactctctacttgcagatgaacagcttaagggctgaggacacggccgtgtattactgtgcgagacattgggtcagtgacccctttgactactggggccagggaaccctggtcaccgtctcaagcg

SEQ ID NO: 570 - DNA, 337 bp, Homo sapiens
gacatccagatgacccagtctccactctccctgcccgtcacccctggagagccggcctccatctcctgcaggtctagtcagagcctcctggatagtaatggatacaaccatttggattggtatgtgcagaagccagggcaatctccacagctcctgatctatttgggttctaatcgggcctccggggtccctgacaggttcagtggcagtggatcaggcacacattttacattgaaaatcagcacagtggaggctgaggatgttggggtttattactgcatgcaatctctacacactcctcaggcgttcggccaagggaccaaggtggaaatcaaac

SEQ ID NO: 571 - DNA, 367 bp, Homo sapiens
gaagttcaattgttagagtctggtggcggtcttgttcagcctggtggttctttacgtctttcttgcgctgcttccggattcactttctctctttacaatatgacttgggttcgccaagctcctggtaaaggtttggagtgggtttcttctatcggtccttctggtggcgatactaagtatgctgactccgttaaaggtcgcttcactatctctagagacaactctaagaatactctctacttgcagatgaacagcttaagggctgaggacacggccgtgtattactgtgcgagagttatgggttattactactactactacggtatggacgtctggggccaagggaccacggtcaccgtctcaagcg

SEQ ID NO: 572 - DNA, 319 bp, Homo sapiens
gacatccagatgacccagtctccagtcaccctgtctgtgtctccaggggaaagagccaccctctcctgcaggtccagtcaacctattctcaacaacttagcctggtaccaacacaaacctggccaggctcccagactcctcatctatggtgcgtccaccagggccactggtatcccagccaggttcagtggcagtgggtctgggacagatttcactcttaccatcagcagcctgcagtctgaggattttgcagtttattactgtcagcagtataataactggatcaccttcggccaagggacacgactggacattaaac

SEQ ID NO: 573 - DNA, 355 bp, Homo sapiens
gaagttcaattgttagagtctggtggcggtcttgttcagcctggtggttctttacgtctttcttgcgctgcttccggattcactttctcttattactggatggattgggttcgccaagctcctggtaaaggtttggagtgggtttctcgtatctatccttctggtggcatgacttggtatgctgactccgttaaaggtcgcttcactatctctagagacaactctaagaatactctctacttgcagatgaacagcttaagggctgaggacacggccgtgtattactgtgcgagaggccggctcaatgggtacttcgatctctggggccgtggcaccctggtcaccgtctcaagcg

SEQ ID NO: 574 - DNA, 331 bp, Homo sapiens
cagagcgaattgactcagcctgcctccgtgtctgggtctcctggacagtcgatcaccatctcctgcagtggaaccagcagtgacgttggtggtcataactttgtctcctggtaccaagagcgcccaggcaaagtccccaaactcatcatttatgatgtcaataatcggccctcagggatctctagtcgcttctccggctccaagtctggcaacacggcctccctgaccatctctgggctccaggctgaggacgaggctgattatttttgcaactcatatacaatcaccggtacttatgtcttcggaactgggaccaaggtcaccgtcctga

SEQ ID NO: 575 - DNA, 367 bp, Homo sapiens
gaagttcaattgttagagtctggtggcggtcttgttcagcctggtggttctttacgtctttcttgcgctgcttccggattcactttctctatgtaccgtatgatgtgggttcgccaagctcctggtaaaggtttggagtgggtttcttctatccgtccttctggtggcatgactatgtatgctgactccgttaaaggtcgcttcactatctctagagacaactctaagaatactctctacttgcagatgaacagcttaagggctgaggacacagccgtgtattactgtacgagaggctgggccctttttggagtggtccgtatgggggactactggggccagggaaccctggtcaccgtctcaagcg

SEQ ID NO: 576 - DNA, 322 bp, Homo sapiens
gacatccagatgacccagtctccaggcaccctgtctttgtctccaggggaaagagccaccctctcctgcagggccagtcagagtgttagcagctacttagcctggtaccaacagaaacctggccaggctcccaggctcctcatctatggtgcatccaacagggccactggcatcccagccaggttcagtggcagtgggtctgggacagacttcactctcaccatcagcagcctggaacctgaagattttgcagtgtatttctgtcagcagtatgctagcccacctcggacttttggccaggggaccaagctggagatgaaac

SEQ ID NO: 577 - DNA, 349 bp, Homo sapiens
gaagttcaattgttagagtctggtggcggtcttgttcagcctggtggttctttacgtctttcttgcgctgcttccggattcactttctctaattactctatgtcttgggttcgccaagctcctggtaaaggtttggagtgggtttcttctatccgttcttctggtggccgtactgattatgctgactccgttaaaggtcgcttcactatctctagagacaactctaagaatactctctacttgcagatgaacagcttaagggctgaggacacggccgtgtattactgtgcaacaggaatagcagtggcccgatattggggccagggcaccctggtcaccgtctcaagcg

SEQ ID NO: 578 - DNA, 325 bp, Homo sapiens
gacatccagatgacccagtctccaggcaccctgtctgtgtttccaggggaaagagccaccctctcctgccgggccagtcagaatattggcatcaacttagcctggtaccagcaaaaacctggccagactcccaggctcctcatttatggtgcatcaagcagggccactggtatcccagccaggttcagtggcagtgggtctgggacagagttcgctctcaccatcagcagcatgcagtctgaagattttgcagtttatttctgtcagcagtatcataggtggcctccgctcactttcggcggagggaccaaggtggagatcaagc

SEQ ID NO: 579 - DNA, 349 bp, Homo sapiens; identical to SEQ ID NO: 577

SEQ ID NO: 580 - DNA, 334 bp, Homo sapiens
gacatccagatgacccagtctccactctccctgcccgtcacccctggagagccggcctccatctcctgcaggtctagtcagagcctcctgcagaataatggatacaactatttggattggtacctgcagaagccagggcagtctccacaactcctgatctttttgggttctaatcgggcctccggggtccctgacaggttcagtggcagtggatcaggcacagattttacactgagaatcagcaaagtggaggctgaggatgttggagtttactactgcatgcaagctcttcacgcccccaccttcggccaagggacacgactggagattagac

SEQ ID NO: 581 - DNA, 358 bp, Homo sapiens
gaagttcaattgttagagtctggtggcggtcttgttcagcctggtggttctttacgtctttcttgcgctgcttccggattcactttctcttggtacggtatgcgttgggttcgccaagctcctggtaaaggtttggagtgggtttcttctatctcttcttctggtggcaagactcgttatgctgactccgttaaaggtcgcttcactatctctagagacaactctaagaatactctctacttgcagatgaacagcttaagggctgaggacacggccgtgtattactgtgcgagagtagatcagtggctacgatcgaatgactactggggccagggcaccctggtcaccgtctcaagcg

SEQ ID NO: 582 - DNA, 322 bp, Homo sapiens
gacatccagatgacccagtctccagccaccctgtctttgtctccaggggaaagagccaccctctcctgcagggccagtcagagtgttagcaactacttagcctggtaccagcagaaacctggccagtctcccaggctcctcatctattatgcatccaccagggccactggcatcccagacaggttcagtggcagtgggtctgggacagacttcactctcaccatcaggagactggagcctgaagattttgcagtctattactgtcagcaatatgcaacctcaccgtggacgttcggccaagggaccaaggtggaaatcaaac

SEQ ID NO: 583 - DNA, 358 bp, Homo sapiens
gaagttcaattgttagagtctggtggcggtcttgttcagcctggtggttctttacgtctttcttgcgctgcttccggattcactttctctaagtactttatgaattgggttcgccaagctcctggtaaaggtttggagtgggtttcttctatctcttcttctggtggcgctactacttatgctgactccgttaaaggtcgcttcactatctctagagacaactctaagaatactctctacttgcagatgaacagcttaagggctgaggacacggccgtgtattactgtgcgaaagtggggtatactaactggtccattgataactggggccagggaaccctggtcaccgtctcaagcg

SEQ ID NO: 584 - DNA, 325 bp, Homo sapiens; identical to SEQ ID NO: 554

SEQ ID NO: 585 - DNA, 364 bp, Homo sapiens
gaagttcaattgttagagtctggtggcggtcttgttcagcctggtggttctttacgtctttcttgcgctgcttccggattcactttctctgcttactggatgtcttgggttcgccaagctcctggtaaaggtttggagtgggtttctggtatcggtccttctggctatacttcttatgctgactccgttaaaggtcgcttcactatctctagagacaactctaagaatactctctacttgcagatgaacagcttaagggctgaggacacggccgtgtattactgtgcgagacttcaggtcgatttttggagtggttattactttgaccagtggggccagggaaccctggtcaccgtctcaagcg

SEQ ID NO: 586 - DNA, 322 bp, Homo sapiens
gacatccagatgacccagtctccttccaccctgtctgcatctgtgggcgacacagtcaccatcacttgccgggccagtcagagtattagtaactgggtggcctggtatcagcagaaaccagggaaagcccctaaggtcttgatctataaggcgtctcttttagagagtggggtcccgtcaaggttcagtggcagtcaatctggggcagacttcactctcaccatcagcagtctgcaacctgaagattttgcagtgtattactgtcagcagtctggtacctcacctttcactttcggccctgggaccaaagtggatctcaaac

SEQ ID NO: 587 - DNA, 364 bp, Homo sapiens
gaagttcaattgttagagtctggtggcggtcttgttcagcctggtggttctttacgtctttcttgcgctgcttccggattcactttctctgcttaccgtatgtattgggttcgccaagctcctggtaaaggtttggagtgggtttctggtatctctccttctggtggcaagactacttatgctgactccgttaaaggtcgcttcactatctctagagacaactctaagaatactctctacttgcagatgaacagcttaagggctgaggacacggccgtgtattactgtgcgagaggccggggcgatattttgactgcttatttcgactactggggccagggcaccctggtcaccgtctcaagcg

SEQ ID NO: 588 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcaaacttttggccaggggaccaagctggagatcaaac

SEQ ID NO: 589 - DNA, 355 bp, Homo sapiens
gaagttcaattgttagagtctggtggcggtcttgttcagcctggtggttctttacgtctttcttgcgctgcttccggattcactttctcttggtactggatgggttgggttcgccaagctcctggtaaaggtttggagtgggtttcttctatctatccttctggtggctttactgattatgctgactccgttaaaggtcgcttcactatctctagagacaactctaagaatactctctacttgcagatgaacagcttaagggctgaggacacggccgtgtattactgtgcgagaggtggggactactactacatggacgtctggggcaaagggaccacggtcaccgtctcaagcg

SEQ ID NO: 590 - DNA, 331 bp, Homo sapiens
gacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgagacagacttcactctcaccatcagcagactggagcctgaagattttgcagtgtattactgtcagcagtatggtagctcacctcggaagtacacttttggccaggggaccaagctggagatcaaac

SEQ ID NO: 591 - DNA, 361 bp, Homo sapiens
gaagttcaattgttagagtctggtggcggtcttgttcagcctggtggttctttacgtctttcttgcgctgcttccggattcactttctctccttacactatgcattgggttcgccaagctcctggtaaaggtttggagtgggtttcttatatctctccttctggtggctggacttcttatgctgactccgttaaaggtcgcttcactatctctagagacaactctaagaatactctctacttgcagatgaacagcttaagggctgaggacacggccgtgtattactgtgcgagagggcagcagtggcctggggttgcttttgaaatctggggccaagggacaatggtcaccgtctcaagcg

SEQ ID NO: 592 - DNA, 331 bp, Homo sapiens
cagtacgaattgactcagccaccctcagcgtctgggacccccgggcagagggtcaccatctcttgttctggaagcagctccaacatcggaagtaattttgtaacctggtaccagcaactcccaggaacggcccccaaactcctcagttataccaataatcagcggccctcaggggtccctgaccgattctctgcctccaagtctggcacctcagcctccctggccatcagtggactccagtctgaggatgaggctgattattactgtgcagcgtgggatgacaacctgaattgtccggtattcggcggagggaccaagctgaccgtcctac

SEQ ID NO: 593 - DNA, 361 bp, Homo sapiens
gaagttcaattgttagagtctggtggcggtcttgttcagcctggtggttctttacgtctttcttgcgctgcttccggattcactttctctaattacggtatgtcttgggttcgccaagctcctggtaaaggtttggagtgggtttctcgtatctggccttctggtggctatactaagtatgctgactccgttaaaggtcgcttcactatctctagagacaactctaagaatactctctacttgcagatgaacagcttaagggctgaggacacggccgtgtattactgtgcgagaggaaaaggttcggggagtttccctcttgactactggggccagggaaccctggtcaccgtctcaagcg

SEQ ID NO: 594 - DNA, 331 bp, Homo sapiens
cagagcgaattgactcagccaccctcagcgtctggaacccccggacagagggtcaccatctcttgttctggaaccctctccaacatcggaactaatatcgtgagctggttccagcagctcccaggaacggcccccaaactcctcatttacaatgatcatcggcggccctcgggggtccctgaccgattctctggctccaagtctgccacctcagcctccctggccatcagtgggctccagtctgaggatgaggctgattattactgtgcagcatgggatgacagcctgaatggtgtggtattcggcggagggaccaagctgaccgtcctaa

SEQ ID NO: 595 - DNA, 373 bp, Homo sapiens
gaagttcaattgttagagtctggtggcggtcttgttcagcctggtggttctttacgtctttcttgcgctgcttccggattcactttctctccttacgctatgtattgggttcgccaagctcctggtaaaggtttggagtgggtttcttatatctctccttctggtggcattactcagtatgctgactccgttaaaggtcgcttcactatctctagagacaactctaagaatactctctacttgcagatgaacagcttaagggctgaggacactgcagtctactattgtgcgagaggagattttgactggttattacatcatcccaatgcttttgatatctggggccaagggacaatggtcaccgtctcaagcg

SEQ ID NO: 596 - DNA, 337 bp, Homo sapiens
gacatccagatgacccagtctccactctccctgcccgtcacccctggagagccggcctccatctcctgcaggtctagtcagagcctcctgcatactcatggatacaactatttggattggtttctgcagaagccaggccagtctccacagctcctgatctatatgggttctaatcgggcctccggggtccctgacaggttcagtggcagtggatcaggcacagattttacattgaaaatcagcagagtggaggctgaggatgttggggtttattattgcatgcaagctcgacaaactccgtacacttttggccaggggaccaagctggagatcaaac

SEQ ID NO: 597 - DNA, 373 bp, Homo sapiens
gaagttcaattgttagagtctggtggcggtcttgttcagcctggtggttctttacgtctttcttgcgctgcttccggattcactttctctgattaccctatgcagtgggttcgccaagctcctggtaaaggtttggagtgggtttcttctatctggtcttctggtggcattactctttatgctgactccgttaaaggtcgcttcactatctctagagacaactctaagaatactctctacttgcagatgaacagcttaagggctgaggacacggccgtgtattactgtgcgagggggacccatgggggggggccaccctggtattactacatggacgtctggggcaaagggaccacggtcaccgtctcaagcg

SEQ ID NO: 598 - DNA, 337 bp, Homo sapiens
gacatccagatgacccagtctccactctccctgtccgtcacccctggagagccggcctccatctcctgcatgtctagtcagagcctcctgtatagtaatggatacaactatttggattggtacctgcagaagccagggcagtctccacagctcctgatctatttgggtgctaatcgggcctccggggtccctgacaggttcagtggcggtggatcaggcacagattttagactgaaaatcagcagagtggaggctgaggatgttggggtttactactgcgtgcaaactctacaaactccgtacacttttggccaggggaccaagctggagatcaaac

SEQ ID NO: 599 - DNA, 370 bp, Homo sapiens
gaagttcaattgttagagtctggtggcggtcttgttcagcctggtggttctttacgtctttcttgcgctgcttccggattcactttctctaattactctatgtcttgggttcgccaagctcctggtaaaggtttggagtgggtttcttatatctattcttctggtggccctactcagtatgctgactccgttaaaggtcgcttcactatctctagagacaactctaagaatactctctacttgcagatgaacagcttaagggctgaggacatggctgtgtattactgtgcgagagggggagggtacagctatggtttccccctaccctttgactactggggccagggaaccctggtcaccgtctcaagcg

SEQ ID NO: 600 - DNA, 319 bp, Homo sapiens
gacatccagatgacccagtctccttccaccctgtctgcatctgtaggagacagagttaccatcacttgtcgggccagtcaaaatattggtacctgggtggtctggtatcagcagagaccagggaaagcccctagcctcctaatctataaggcgtctactttggaaagtggggtcccatcaaggttcagcggcagtggatctggtacagagttcactctcaccatcagcagcctgcagcctgatgattttgcaacttattactgccaacaattttatacttctaagaccttcggccaagggaccaaggtggaaatcaaac

SEQ ID NO: 601 - DNA, 349 bp, Homo sapiens; identical to SEQ ID NO: 577

SEQ ID NO: 602 - DNA, 337 bp, Homo sapiens
gacatccagatgacccagtctccactctccctgcccgtcacccctggagagccggcctccatctcctgcaggtctagtcagagcctcctgcagagtaatggatacaactatttggattggtacctgcagaagccagggcagtctccacaactcctaatctatttgggttctaatcgggcctccggggtccctgacaggttcagtggcagtggatcaggcacagattttacactgataatcagcagagtggaggctgacgatgttggggtttattactgcatgcaaggtctacaaactcctcatacttttggccaggggaccaagctggagatcaaac

SEQ ID NO: 603 - DNA, 355 bp, Homo sapiens
gaagttcaattgttagagtctggtggcggtcttgttcagcctggtggttctttacgtctttcttgcgctgcttccggattcactttctcttggtacatgatgcattgggttcgccaagctcctggtaaaggtttggagtgggtttcttctatcggttcttctggtggctttactacttatgctgactccgttaaaggtcgcttcactatctctagagacaactctaagaatactctctacttgcagatgaacagcttaagggctgaggacacggccgtgtattactgtgccacaggggctatgggaagcgcttttgatatctggggccaagggacaatggtcaccgtctcaagcg

SEQ ID NO: 604 - DNA, 325 bp, Homo sapiens
gacatccagatgacccagtctccaggcaccctgtctttgtctccaggggaaagagccaccgtctcctgcagggccagtcagagtgttagcagcagctacttagcctggtaccagcagaaacctggcctggcgcccaggctcctcatctatgatgcatccaacagggccactggcatcccggacaggttcagtggcagtgggtctgggacagacttcactctcaccatcaccagactggagcctgaagattttgcagtgtattactgtcagcagtacagtacctcacccttcactttcggccctgggaccaaagtggatatcaaac

SEQ ID NO: 605 - DNA, 349 bp, Homo sapiens; identical to SEQ ID NO: 577

SEQ ID NO: 606 - DNA, 325 bp, Homo sapiens
gacatccagatgacccagtctccaggcaccctgtctttgtctccaggggaaagagccaccctctcctgcagggccagtcagagtgttagcagcaactacttagcctggtaccagcagaaacctggccaggctcccaggctcctcatgtatggtgcatccaccagggccactggcgtcccagacagattcagtggcagtgggtctgggacagagttcactctcaccatcaacagcctgcagtctgaagattttgcagtttattactgtcaacagtataattattggcctcggacgttcggcacagggaccaaggtggaaatcaaac

SEQ ID NO: 607 - DNA, 358 bp, Homo sapiens
gaagttcaattgttagagtctggtggcggtcttgttcagcctggtggttctttacgtctttcttgcgctgcttccggattcactttctctaagtacaatatgttttgggttcgccaagctcctggtaaaggtttggagtgggtttctgttatcggttcttctggtggcactactggttatgctgactccgttaaaggtcgcttcactatctctagagacaactctaagaatactctctacttgcagatgaacagcttaagggctgaggacacagccacgtattactgtgcgagagaaaaaggtatagcagcagcttatgactactggggccagggaaccctggtcaccgtctcaagcg

SEQ ID NO: 608 - DNA, 325 bp, Homo sapiens
gacatccaaatgacccagtctccaggcaccctgtctttgtctccaggggaaagagccaccctctcctgctgggccagtcagagtgttaaaagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaac

SEQ ID NO: 609 - DNA, 355 bp, Homo sapiens
gaagttcaattgttagagtctggtggcggtcttgttcagcctggtggttctttacgtctttcttgcgctgcttccggattcactttctctctttacaagatgatgtgggttcgccaagctcctggtaaaggtttggagtgggtttcttctatctattcttctggtggccgtactaattatgctgactccgttaaaggtcgcttcactatctctagagacaactctaagaatactctctacttgcagatgaacagcttaagggctgaggacacggccgtgtattactgtgccacagatgtgacgtggtggccccgaagctactggggccagggaaccctggtcaccgtctcaagcg

SEQ ID NO: 610 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccctcactttcggcggagggaccaaggtggagatcaaac

SEQ ID NO: 611 - DNA, 361 bp, Homo sapiens
gaagttcaattgttagagtctggtggcggtcttgttcagcctggtggttctttacgtctttcttgcgctgcttccggattcactttctctatgtactctatgcattgggttcgccaagctcctggtaaaggtttggagtgggtttctggtatctcttcttctggtggcgctactaagtatgctgactccgttaaaggtcgcttcactatctctagagacaactctaagaatactctctacttgcagatgaacagcttaagggctgaggacacggctgtgtattactgtgcgagagcggcgcccatttacaactactacatggacgtctggggcaaagggaccacggtcaccgtctcaagcg

SEQ ID NO: 612 - DNA, 325 bp, Homo sapiens
gacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 613 - DNA, 349 bp, Homo sapiens
gaagttcaattgttagagtctggtggcggtcttgttcagcctggtggttctttacgtctttcttgcgctgcttccggattcactttctctcgttactctatgggttgggttcgccaagctcctggtaaaggtttggagtgggtttcttatatctcttcttctggtggcgttactggttatgctgactccgttaaaggtcgcttcactatctctagagacaactctaagaatactctctacttgcagatgaacagcttaagggctgaggacacggccgtgtattactgtgcaacaggaatagcagtggcccgatattggggccagggcaccctggtcaccgtctcaagcg

SEQ ID NO: 614 - DNA, 322 bp, Homo sapiens
gacatccagatgacccagtctccagccaccctgtctgtgtctccaggggaaacagccaccctctcctgctgggccagtcagagtgttaagagcaacttagcctggtaccagcagaaacctggccaggctcccaggctcctcatatatggtgcaactaccagggccactggtgtcccagccaggttcagcggcagtgggtctaggacagagttcactctcaccatcagtggcctgcagtctgaagattttgcagtctattattgtcagcagtatgatgtttggccattcactttcggccctgggaccacggtggatatcaaac

SEQ ID NO: 615 - DNA, 343 bp, Homo sapiens
gaagttcaattgttagagtctggtggcggtcttgttcagcctggtggttctttacgtctttcttgcgctgcttccggattcactttctctcattaccgtatgggttgggttcgccaagctcctggtaaaggtttggagtgggtttcttatatctattcttctggtggccttacttcttatgctgactccgttaaaggtcgcttcactatctctagagacaactctaagaatactctctacttgcagatgaacagcttaagggctgaggacacagccgtgtattactgtaccacaggggccttggggcaatggggccagggcaccctggtcaccgtctcaagcg

SEQ ID NO: 616 - DNA, 322 bp, Homo sapiens
gacatccagatgacccagtctccatcctccctgtctgcatctgtaggagacagagtcaccatcacttgccgggcaagtcagaggattagcatctatttaaattggtatcagcaaaaaccagggaaagcccctaagctcctgatttatgctgcagacaatttgcaaagtggggtcccctctaggttcagtggcagtggatctgggacagacttcactctcaccatcagcagtctgcaacctgaggactttgcaacttactactgtcaacagagtgacagttcccctcggacgttcggccaagggaccaaggtggaaatcaaac

SEQ ID NO: 617 - DNA, 358 bp, Homo sapiens
gaagttcaattgttagagtctggtggcggtcttgttcagcctggtggttctttacgtctttcttgcgctgcttccggattcactttctctggttacgagatgcagtgggttcgccaagctcctggtaaaggtttggagtgggtttcttctatcgtttcttctggtggcaagacttattatgctgactccgttaaaggtcgcttcactatctctagagacaactctaagaatactctctacttgcagatgaacagcttaagggctgaggacactgcagtctactattgtgcgagaggccgcttagtctggaacgaccttgactactggggccagggaaccctggtcaccgtctcaagcg

SEQ ID NO: 618 - DNA, 328 bp, Homo sapiens
gacatccagatgacccagtctccaggcaccctgtctttgtctccaggggtaagagccgccctctcctgcagggccagtcagagtgttagcagcagctacttagcctggtaccagcataaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgatcaccttcggccaagggacacgactggagattaaac

SEQ ID NO: 619 - DNA, 370 bp, Homo sapiens
gaagttcaattgttagagtctggtggcggtcttgttcagcctggtggttctttacgtctttcttgcgctgcttccggattcactttctctcgttactctatgacttgggttcgccaagctcctggtaaaggtttggagtgggtttcttatatctctccttctggtggcgatactctttatgctgactccgttaaaggtcgcttcactatctctagagacaactctaagaatactctctacttgcagatgaacagcttaagggctgaggacacggccgtgtattactgtgcgagagattggaggggcagcagctggctccccaccggtatggacgtctggggccaagggaccacggtcaccgtctcaagcg

SEQ ID NO: 620 - DNA, 334 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccactttcggcggagggaccaaggtggagatcaaac

SEQ ID NO: 621 - DNA, 370 bp, Homo sapiens
gaagttcaattgttagagtctggtggcggtcttgttcagcctggtggttctttacgtctttcttgcgctgcttccggattcactttctctcattaccgtatgatttgggttcgccaagctcctggtaaaggtttggagtgggtttcttctatctctccttctggtggccgtactggttatgctgactccgttaaaggtcgcttcactatctctagagacaactctaagaatactctctacttgcagatgaacagcttaagggctgaggacacggccgtgtattactgtgcgagagggggctatgatagtagtggttattattactacttcgatctctggggccgtggcaccctggtcaccgtctcaagcg

SEQ ID NO: 622 - DNA, 334 bp, Homo sapiens
gacatccagatgacccagtctccagacaccctgtctttgtctccaggagaaagcgccaccctctcttgtagggccagtgagagtattagcctcaactccttagcctggtaccaacataaacctggccagcctcccagactcctcatccacggcgcatcctacagggcctctggcatcccactcaggttcattggcagtgggtctgggacaggcttcactctcactatcagcagactggagcctgaagattctgcagtgtattactgtcagcaatatcagcaacgtagttcacccgcgctcactttcggcggcgggaccaaggtggagatcaaac

SEQ ID NO: 623 - DNA, 370 bp, Homo sapiens
gaagttcaattgttagagtctggtggcggtcttgttcagcctggtggttctttacgtctttcttgcgctgcttccggattcactttctcttggtaccatatgatttgggttcgccaagctcctggtaaaggtttggagtgggtttctcgtatcggtccttctggtggctttactgagtatgctgactccgttaaaggtcgcttcactatctctagagacaactctaagaatactctctacttgcagatgaacagcttaagggctgaggacaccgccatgtattactgtgcgagagcctacgatttttggagtggttatccgtctgcttttgatatctggggccaagggacaatggtcaccgtctcaagcg

SEQ ID NO: 624 - DNA, 319 bp, Homo sapiens
gacatccagatgacccagtctccaggcaccctgtctgtgtctccaggggaaagagccaccctctcctgcagggccagtcagagtgttagcaacaacttagcctggtaccagcagagacctggccaggctcccaggctcctcatctatagtgcatccaccagggccactggtatcccagccaggttcagtggcagtgggtctgggacagagttcactctcaccatcagcagcctgcagtctgaagattttgcaatttactactgtcaacagagttacagtaccctcactttcggccctgggaccaaagtggatatcaaac

SEQ ID NO: 625 - DNA, 355 bp, Homo sapiens
gaagttcaattgttagagtctggtggcggtcttgttcagcctggtggttctttacgtctttcttgcgctgcttccggattcactttctctaagtacaatatgggttgggttcgccaagctcctggtaaaggtttggagtgggtttctggtatctggccttctggtggctggactttttatgctgactccgttaaaggtcgcttcactatctctagagacaactctaagaatactctctacttgcagatgaacagcttaagggctgaggacatggctgtgtattactgtgcgagagtttcggagtatggatcttttgactactggggccagggaaccctggtcaccgtctcaagcg

SEQ ID NO: 626 - DNA, 322 bp, Homo sapiens
gacatccagatgacccagtctccatcttccgtgtctgcatctgtaggagacagagtcactatcacttgtcgggcgagtcaggatattgtcacctacttagcctggtatcagcagacaccggggaaagcccctaagctcctgatctattctgcatccactttgcaaagtgaggtcccatcaaggttcagcggcagtggatctgggacagatttcactctcagcatcagcagcctgcagcctgaagattttgcaacttactattgtcagcaggggaacagtttcccgcccactttcggcggagggaccaaggtggagatcaaac

SEQ ID NO: 627 - DNA, 361 bp, Homo sapiens
gaagttcaattgttagagtctggtggcggtcttgttcagcctggtggttctttacgtctttcttgcgctgcttccggattcactttctctgcttacggtatggagtgggttcgccaagctcctggtaaaggtttggagtgggtttcttatatctatccttctggtggctggactcagtatgctgactccgttaaaggtcgcttcactatctctagagacaactctaagaatactctctacttgcagatgaacagcttaagggctgaggacacggccgtgtattactgtgcgagagatatccccaggggagctagtgcttttgatatctggggccaagggacaatggtcaccgtctcaagcg

SEQ ID NO: 628 - DNA, 322 bp, Homo sapiens
aacatccagatgacccagtctccatcttccgtgtctgcatctgtaggagacagagtcaccatcacttgtcgggcgagtcagggtattagcagctggttagcctggtatcagcagaagccagggaaagcccctaagctcctgatctatgctgcatccagtttgcaaagtggggtcccatcaaggttcagcggcagtggatctgggacagatttcactctcaccatcagcagcctgcagcccgaagattttgcaacttatcattgtcaacaggctgacagtttcccattcactttcggccctgggaccaaagtggatgtcaaac

SEQ ID NO: 629 - DNA, 352 bp, Homo sapiens
gaagttcaattgttagagtctggtggcggtcttgttcagcctggtggttctttacgtctttcttgcgctgcttccggattcactttctctggttactctatggtttgggttcgccaagctcctggtaaaggtttggagtgggtttctcgtatctctccttctggtggctatactaattatgctgactccgttaaaggtcgcttcactatctctagagacaactctaagaatactctctacttgcagatgaacagcttaagggctgaggacacggccgtgtattactgtgcgagagattttggctacggtatggacgtctggggccaagggaccacggtcaccgtctcaagcg

SEQ ID NO: 630 - DNA, 328 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattctccgatgtacacttttggccaggggaccaagctggagatcaaac

SEQ ID NO: 631 - DNA, 370 bp, Homo sapiens
gaagttcaattgttagagtctggtggcggtcttgttcagcctggtggttctttacgtctttcttgcgctgcttccggattcactttctctggttacaatatgttttgggttcgccaagctcctggtaaaggtttggagtgggtttctgttatcgttccttctggtggccttacttcttatgctgactccgttaaaggtcgcttcactatctctagagacaactctaagaatactctctacttgcagatgaacagcttaagggctgaggacacggccgtgtattactgtgcaaaagatataggaagcagcagcggggactactacggtatggacgtctggggccaagggaccacggtcaccgtctcaagcg

SEQ ID NO: 632 - DNA, 325 bp, Homo sapiens
gacatccagatgacccagtctccaggcaccctgtctgtgtctccaggggaaagagtcaccctctcctgcagggccagtcagagtgttggcagcaacttagcctggtaccagcagaaagctggccaggctcccaggctcctcttctatgatgcatccaccagggccactggtatcccagacaggttcagtggcagtgggtctgggagagacttcactctcaccatcagcggcctgcactctgaagattttgcagtttatttctgtcatcactatgatgactggtccccagggacgttcggccaaggaaccaaggtggagatcaaac

SEQ ID NO: 633 - DNA, 361 bp, Homo sapiens
gaagttcaattgttagagtctggtggcggtcttgttcagcctggtggttctttacgtctttcttgcgctgcttccggattcactttctctcgttacgctatgttttgggttcgccaagctcctggtaaaggtttggagtgggtttctggtatctggtcttctggtggctttactcagtatgctgactccgttaaaggtcgcttcactatctctagagacaactctaagaatactctctacttgcagatgaacagcttaagggctgaggacacggccgtgtattactgtgcgagagtccgggtgggaagtaccggcaactttgactactggggccagggaaccctggtcaccgtctcaagcg

SEQ ID NO: 634 - DNA, 334 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaacactcactttcggccctgggaccaaagtggatatcaaac

SEQ ID NO: 635 - DNA, 373 bp, Homo sapiens
gaagttcaattgttagagtctggtggcggtcttgttcagcctggtggttctttacgtctttcttgcgctgcttccggattcactttctctcgttaccatatggtttgggttcgccaagctcctggtaaaggtttggagtgggtttcttctatcgttccttctggtggctctactcattatgctgactccgttaaaggtcgcttcactatctctagagacaactctaagaatactctctacttgcagatgaacagcttaagggctgaggacaccgccatgtattactgtgccagagatctggggtcgtatagcagtggctggggcggttggttcgacccctggggccagggaaccctggtcaccgtctcaagcg

SEQ ID NO: 636 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcactttcggcggagggaccaaggtggagatcaaac

SEQ ID NO: 637 - DNA, 364 bp, Homo sapiens
gaagttcaattgttagagtctggtggcggtcttgttcagcctggtggttctttacgtctttcttgcgctgcttccggattcactttctctccttacggtatgtcttgggttcgccaagctcctggtaaaggtttggagtgggtttcttatatctattcttctggtggcaagactcattatgctgactccgttaaaggtcgcttcactatctctagagacaactctaagaatactctctacttgcagatgaacagcttaagggctgaggacacggccgtgtattactgtgctagaggtccgggtggtggtaacacctactactttgactactggggccagggcaccctggtcaccgtctcaagcg

SEQ ID NO: 638 - DNA, 325 bp, Homo sapiens
gacatccagatgacccagtctccaggcaccctgtctgtgtctccaggggaaagggccaccctctcatgcagggccagtcagagtattggcggcaacttagcctggtaccagcagaaacctggccaggcgcccagactcctcatctattatgcatccaccagggccactggtatcccagccaggttcagtggcagtgggtctgggacagacttcgctctcaccatcagcagactggagcctgaagattctgcagtgtatttctgtcagcaccgtagcaactggcctccgctgacgttcggccaagggaccaaggtagaagtcaaac

SEQ ID NO: 639 - DNA, 361 bp, Homo sapiens
gaagttcaattgttagagtctggtggcggtcttgttcagcctggtggttctttacgtctttcttgcgctgcttccggattcactttctctcgttacgctatgggttgggttcgccaagctcctggtaaaggtttggagtgggtttcttatatctctccttctggtggcatgacttggtatgctgactccgttaaaggtcgcttcactatctctagagacaactctaagaatactctctacttgcagatgaacagcttaagggctgaggacacggccgtgtattactgtgcgagggatagaagaatatttgactatgcttttgatatctggggccaagggaccacggtcaccgtctcaagcg

SEQ ID NO: 640 - DNA, 322 bp, Homo sapiens
gacatccagatgacccagtctccagccaccctgtctgcatctgtaggagacagagtcaccatcacttgccggacaagtcagactattagtcattatttaaattggtatcagcagaaaccagggagagcccctaagctcctgatctatgctatttccaacttgcaaagtggggtcccatcaaggttcagtggcagtggatctgggacagatttcactctcaccatcagcagtctgcaacctgaagattttgcaacttactactgtcaaaagtataacagtgccccgtacacttttggccaggggaccaagctggagatcaaac

SEQ ID NO: 641 - DNA, 376 bp, Homo sapiens
gaagttcaattgttagagtctggtggcggtcttgttcagcctggtggttctttacgtctttcttgcgctgcttccggattcactttctcttattacattatgcattgggttcgccaagctcctggtaaaggtttggagtgggtttctggtatctctccttctggtggcattactgtttatgctgactccgttaaaggtcgcttcactatctctagagacaactctaagaatactctctacttgcagatgaacagcttaagggctgaggacacggccgtgtattactgtgccctccggggggtaccagctgctagggactactactactactacatggacgtctggggcaaagggaccacggtcaccgtctcaagcg

SEQ ID NO: 642 - DNA, 337 bp, Homo sapiens
gacatccagatgacccagtctccactctccctgcccgtcactcctggagagccggcctccatctcctgcaggtctagtcagagcctcctgcatactaatggatacaactatttggattggtacctgcagaagccagggcagtctccacagctcctgatttatttgggttcttatcgggcctccggggtccctgacaggttcagtggcggaggatcaggcacagattttacactgaaaatcagcagagtggaggcggacgatgttggggtttattactgcatgcaaggtctacaaaccccgatcaccttcggcccagggacacgactggggattaaac

SEQ ID NO: 643 - DNA, 358 bp, Homo sapiens
gaagttcaattgttagagtctggtggcggtcttgttcagcctggtggttctttacgtctttcttgcgctgcttccggattcactttctctggttactctatggtttgggttcgccaagctcctggtaaaggtttggagtgggtttcttatatcggttcttctggtggcaagactatgtatgctgactccgttaaaggtcgcttcactatctctagagacaactctaagaatactctctacttgcagatgaacagcttaagggctgaggacacggccgtgtattactgtgcgagagcggcccccagtggctggtactatgactactggggccagggaaccctggtcaccgtctcaagcg

SEQ ID NO: 644 - DNA, 325 bp, Homo sapiens
gacatccagatgacccagtctccaggcaccctgtctttgtctccaggggaaagagccaccctctcctgcagggccagtcagactgttagcagcgcctacttagcctggtaccagcagagacctggccaggctcccaggctcctcatctatggtgcatccagcagggccactggcgtcccagacaggttcagtggcagtgggtctgggacagacttcactctcaccatcaacagactggagcctgaagattttgcagtgtattactgtcagcagtttggtgtctcatcgtggacgttcggccaagggaccaaggtggaaatcaaac

SEQ ID NO: 645 - DNA, 355 bp, Homo sapiens
gaagttcaattgttagagtctggtggcggtcttgttcagcctggtggttctttacgtctttcttgcgctgcttccggattcactttctctatttacaatatgtattgggttcgccaagctcctggtaaaggtttggagtgggtttctggtatccgtccttctggtggccctactacttatgctgactccgttaaaggtcgcttcactatctctagagacaactctaagaatactctctacttgcagatgaacagcttaagggctgaggacacggccgtgtattactgtgcgagagcaaaatggggatggtacttcgatctctggggccgtggcaccctggtcaccgtctcaagcg

SEQ ID NO: 646 - DNA, 322 bp, Homo sapiens
gacatccagatgacccagtctccatcctccctgtctgcatctgtaggagacagagtcaccatcacttgccgggcaagtcagagcattggcacctatttaaattggtatcaacagaaaccagggacaccccctaagctcctgatgtatgctgcctccagattgcaacctggggtcccatcaaggttcagtggcagtggatctctgacagaattcactctcaccatcagcaatctgcaacctgaagattttgcatcgtattactgtcaacaaagttatattgcccctcccaccttcggcggagggaccaaagtggaaatcaaac

SEQ ID NO: 647 - DNA, 385 bp, Homo sapiens
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttcttatatcggtccttctggtggctatactctttatgctgactccgttaaaggtcgcttcactatctctagagacaactctaagaatactctctacttgcagatgaacagcttaagggctgaggacactgcagtctactattgtgcgagagataagtactatggttcggggagttatcctcggtactactactactacatggacgtctggggcaaagggaccacggtcaccgtctcaagcg

SEQ ID NO: 648 - DNA, 334 bp, Homo sapiens
gacatccagatgacccagtctccactctccctgcccgtcacccctggagagccggcctccatctcctgcaggtctagtcagagcctcctgcatggtaatggatacaactatttggattggtacctgcagaagccagggcagtctccacagctcctggtctatttgggttctaatcgggcctccggggtccctgaccggttcagtggcagtggatcaggcacagattttacactgcaaatcagcagagtggaggctgaggatgttggggtttattactgcatgcaagctctacaaactcccactttcggcggagggaccaaggtggagatcaaac

SEQ ID NO: 649 - DNA, 364 bp, Homo sapiens
gaagttcaattgttagagtctggtggcggtcttgttcagcctggtggttctttacgtctttcttgcgctgcttccggattcactttctctcattacggtatgatgtgggttcgccaagctcctggtaaaggtttggagtgggtttcttctatctggccttctggtggcaagactgattatgctgactccgttaaaggtcgcttcactatctctagagacaactctaagaatactctctacttgcagatgaacagcttaagggctgaggacacggccgtgtattactgtgcgagaggaactacggtttggtggaactactacatggacgtctggggcaaagggaccacggtcaccgtctcaagcg

SEQ ID NO: 650 - DNA, 328 bp, Homo sapiens
gacatccagatgacccagtctccaggcaccctgtctttgtctccaggggaaagagccaccctctcttgcagggccagtcagagtgttagcagcagctatttagcctggtaccagcagaaacctggccaggctcccaggctcctcatttatggtgcatccagcagggccactggcatcccagacaggttcagtggcagtgggtctgggacagacttcactctcaccatcagcagactggagcctgaagattttgcagtgtattactgtcaacagtatggtatctcccctccgtatagttttggccaggggaccaagctggagatcaaac

SEQ ID NO: 651 - DNA, 355 bp, Homo sapiens
gaagttcaattgttagagtctggtggcggtcttgttcagcctggtggttctttacgtctttcttgcgctgcttccggattcactttctctatttacgctatgggttgggttcgccaagctcctggtaaaggtttggagtgggtttctggtatcgttccttctggtggccctactaattatgctgactccgttaaaggtcgcttcactatctctagagacaactctaagaatactctctacttgcagatgaacagcttaagggctgaggacactgccgtgtattactgtgcgagaatcatgtggtacggccagtttgactactggggccagggaaccctggtcaccgtctcaagcg

SEQ ID NO: 652 - DNA, 322 bp, Homo sapiens
gacatccagatgacccagtctccatcctccctgtctgcatctgtaggagacagagtcaccatcacttgccgggcaagtcagagcattagcagctatttaaattggtatcagaagagaccagggaaagcccctaatctcctgatctatggtgcagacactttacaaactggggtcccatcaaggttcagtggcgatggatctgggacagacttcactctcaccatcaacagtctgcagcctgaagatttcgcaacttactactgtcaacagagttacagtacttcgtggacgttcggccaggggaccaaagtagaagtcagac

SEQ ID NO: 653 - DNA, 355 bp, Homo sapiens
gaagttcaattgttagagtctggtggcggtcttgttcagcctggtggttctttacgtctttcttgcgctgcttccggattcactttctctggttacgttatgtcttgggttcgccaagctcctggtaaaggtttggagtgggtttcttctatcggtccttctggtggcactactaagtatgctgactccgttaaaggtcgcttcactatctctagagacaactctaagaatactctctacttgcagatgaacagcttaagggctgaggacacagccacatattactgtgcgaaagatcgaggcctctactactttgactactggggccagggaaccctggtcaccgtctcaagcg

SEQ ID NO: 654 - DNA, 340 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctccgtggacgttcggccaagggaccaaggtggaaatcaaac

SEQ ID NO: 655 - DNA, 367 bp, Homo sapiens
gaagttcaattgttagagtctggtggcggtcttgttcagcctggtggttctttacgtctttcttgcgctgcttccggattcactttctcttcttacactatgatttgggttcgccaagctcctggtaaaggtttggagtgggtttctcgtatctctccttctggtggccatactgagtatgctgactccgttaaaggtcgcttcactatctctagagacaactctaagaatactctctacttgcagatgaacagcttaagggctgaggacacggccgtgtattactgtgccggtcactatggttcggggagttattacgcctccctcgactactggggccagggaaccctggtcaccgtctcaagcg

SEQ ID NO: 656 - DNA, 337 bp, Homo sapiens
gacatccagatgacccagtctccactctccctgcccgtcacccctggagagccggcctccatctcctgcaagtctagtcagagcctccttcattttaatggatacagttatttggattggtacctgcagaagccagggcagtctccacagctcctgatctatttggcttctaatcgggcctccggggtccctgacaggttcagtggcagtggatcaggcacagattttacactgaacatcagcagagtggaggctgaggatgttggggtttattactgcatgcaagctctacaaactcctctcactttcggcgaagggaccaaggtgcagatgaaac

SEQ ID NO: 657 - DNA, 361 bp, Homo sapiens
gaagttcaattgttagagtctggtggcggtcttgttcagcctggtggttctttacgtctttcttgcgctgcttccggattcactttctctggttacgctatgcagtgggttcgccaagctcctggtaaaggtttggagtgggtttcttctatctctccttctggtggcgatacttcttatgctgactccgttaaaggtcgcttcactatctctagagacaactctaagaatactctctacttgcagatgaacagcttaagggctgaggacacagccgtgtattactgtacgagatctggaacgggatactactactacatggacgtctggggcaaagggaccacggtcaccgtctcaagcg

SEQ ID NO: 658 - DNA, 337 bp, Homo sapiens
aacatccagatgacccagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgatcaccttcggccaagggacacgactggagattaaac

SEQ ID NO: 659 - DNA, 349 bp, Homo sapiens
gaagttcaattgttagagtctggtggcggtcttgttcagcctggtggttctttacgtctttcttgcgctgcttccggattcactttctctcgttacgctatgtggtgggttcgccaagctcctggtaaaggtttggagtgggtttctggtatcgttccttctggtggccttactacttatgctgactccgttaaaggtcgcttcactatctctagagacaactctaagaatactctctacttgcagatgaacagcttaagggctgaggacacggccgtgtattactgtgcaagagttcatgatgcttttgatatctggggccaagggacaatggtcaccgtctcaagcg

SEQ ID NO: 660 - DNA, 337 bp, Homo sapiens
aacatccagatgacccaatctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggacgttggggtttattactgcatgcaagctctacaaaactcgatcaccttcggccaagggacacgactggagattaaac

SEQ ID NO: 661 - DNA, 373 bp, Homo sapiens
gaagttcaattgttagagtctggtggcggtcttgttcagcctggtggttctttacgtctttcttgcgctgcttccggattcactttctctcgttacgctatgtggtgggttcgccaagctcctggtaaaggtttggagtgggtttctggtatcgttccttctggtggccttactacttatgctgactccgttaaaggtcgcttcactatctctagagacaactctaagaatactctctacttgcagatgaacagcttaagggctgaggacacggccgtgtattactgtgcgagacatgaggtttccgagcagtggctgttcccggggaactttgactactggggccaggggaccctggtcaccgtctcaagcg

SEQ ID NO: 662 - DNA, 337 bp, Homo sapiens; identical to SEQ ID NO: 658

SEQ ID NO: 663 - DNA, 373 bp, Homo sapiens
gaagttcaattgttagagtctggtggyggtcttgttcagcctggtggttctttrcgtctttcttgcgctgcttccggattcactttctctcgttacgctatgtggtgggttcgccaagctcctggtaarggyttggagtgggtttctggtatcgttccttctggtggccttactacttatgctgactccgttaaaggtcgcttcactatctctagagacaactctaagaatactctctacttgcagatgaacagcttaagggctgaggacacggccgtgtattactgtgcgagacatgaggtttcmgagcagtggctgttcccggggaactttgactactggggccaggggaccctggtcaccgtctcaagcg

SEQ ID NO: 664 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacagattcagcggcagtgggtcaggcactgatttcacactgaaaatcagcagggtggaggctgaggatgttggggtttattactgcatgcaaggtacacactggccgatcaccttcggccaagggacacgactggagattaaac

SEQ ID NO: 665 - DNA, 352 bp, Homo sapiens
gaagttcaattgttagagtctggtggcggtcttgttcagcctggtggttctttacgtctttcttgcgctgcttccggattcactttctctgcttacggtatggattgggttcgccaagctcctggtaaaggtttggagtgggtttcttctatccctccttctggtggccagactaagtatgctgactccgttaaaggtcgcttcactatctctagagacaactctaagaatactctctacttgcagatgaacagcttaagggctgaggacacggccgtgtattactgtgccagagtcggcctttgggcttttgatatctggggccaagggacaatggtcaccgtctcaagcg

SEQ ID NO: 666 - DNA, 337 bp, Homo sapiens
aacatccagatgacccagtctccactctccctgcccgtcacccttggacagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactcgatcaccttcggccaagggacacgactggagattaaac

SEQ ID NO: 667 - DNA, 364 bp, Homo sapiens
gaagttcaattgttagagtttggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcgagagttgtacgcggatactactactacggtatggacgtctggggccaagggaccacggtcaccgtctcaagcg

SEQ ID NO: 668 - DNA, 337 bp, Homo sapiens; identical to SEQ ID NO: 666

SEQ ID NO: 669 - DNA, 373 bp, Homo sapiens; identical to SEQ ID NO: 661

SEQ ID NO: 670 - DNA, 337 bp, Homo sapiens; identical to SEQ ID NO: 658

SEQ ID NO: 671 - DNA, 370 bp, Homo sapiens
gaagttcaattgttagagtctggtggcggtcttgttcagcctggtggttctttacgtctttcttgcgctgcttccggattcactttctctgcttacggtatggattgggttcgccaagctcctggtaaaggtttggagtgggtttcttctatctctccttctggtggccagactaagtatgctgactccgttaaaggtcgcttcactatctctagagacaactctaagaatactctctacttgcagatgaacagcttaagggctgaggacacggccgtgtattactgtgcgaaagaccttgggggggggtactactactactacggtatggacgtctggggccaaggcaccctggtcaccgtctcaagcg

SEQ ID NO: 672 - DNA, 370 bp, Homo sapiens; identical to SEQ ID NO: 671

SEQ ID NO: 673 - DNA, 337 bp, Homo sapiens
gacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttagggtttattactgcatgcaagctctacaaaactcgatcaccttcggccaagggacacgactggagattaaac

SEQ ID NO: 674 - DNA, 364 bp, Homo sapiens
gaagttcacttgttagagtctggtggcggtcttgttcagcctggtggttctttacgtctttcttgcgctgcttccggattcactttctccgtttactttatgtcttgggttcgccaagctcctggtaaaggtttggagtgggtttcttatatcggtccttctggtggctttacttcttatgctgactccgttaaaggtcgcttcactatctctagagacaactctaagaatactctctacttgcagatgaacagcttaagggctgaggacacggccgtgtattactgtgcgagagttgtacgcggatactactactacggtatggacgtctggggccaagggaccacggtcaccgtctcaagcg

SEQ ID NO: 675 - DNA, 322 bp, Homo sapiens
cagagcgctttgactcagccaccctcactgtccgtgtccccgggacagacagccaccatcacctgctctggagataaattgggggataaatatacttcctggtatcaacagaggccaggccaatcccctgtattggtcctctataaagataataagcgaccctcagggatccctcagcgattctctggctccaactctgggaacacagccactctgaccattagcgggacccaggctgtggatgaagctgactattactgtcaggcgtgggacagtaaggagttttatgtcttcggaactgggaccaaggtcaccgtcctag

SEQ ID NO: 676 - DNA, 379 bp, Homo sapiens
gaagttcaattgttagagtctggtggcggtcttgttcagcctggtggttctttacgtctttcttgcgctgcttccggattcactttctctatttacaagatgcattgggttcgccaagctcctggtaaaggtttggagtgggtttcttctatcgtttcttctggtggcgctactcagtatgctgactccgttaaaggtcgcttcactatctctagagacaactctaagaatactctctacttgcagatgaacagcttaagggctgaggacacggccgtgtattactgtgcgagagtcggttgggtattacgatttttggagtggttacccgactcctttgactactggggccagggaaccctggtcaccgtctcaagcg

SEQ ID NO: 677 - DNA, 319 bp, Homo sapiens
cagtacgaattgactcagccaccctctgtgtccgtgtccccaggacagacagccattatcacctgctctggagatagattgggggataaatatgcttcttggtatcaacagaagccaggccagtcccctgtgctggtcatctatcaagataccaagcggccctcagggatccctgagcggttctctggctccaactctggggacacagccactctgaccatcagcgggacccaggctatggatgacgctgactattactgtcactcgtgggacagcagaactgggattttcggcggagggacgaagctgaccgtcctac

SEQ ID NO: 678 - DNA, 394 bp, Homo sapiens
gaagttcaattgttagagtctggtggcggtcttgttcagcctggtggttctttacgtctttcttgcgctgcttccggattcactttctctaagtacaatatgcattgggttcgccaagctcctggtaaaggtttggagtgggtttcttctatctcttcttctggtggcaatactgattatgctgactccgttaaaggtcgcttcactatctctagagacaactctaagaatactctctacttgcagatgaacagcttaagggctgaggacacagccacatattactgtgcgagagtcttcccctttagagatggctacaattactggtttggtggggattctcgggatgcttttgatatctggggccaagggacaatggtcaccgtctcaagcg

SEQ ID NO: 679 - DNA, 319 bp, Homo sapiens
cagagcgctttgactcagccaccctcagtgtccgtgtccccaggacagacagccagcatcacctgctctgcagataaattgggggatagatatgcttcctggtatcagcagaagccaggccagtcccctgtgctagtcatctatcaagatagtaagcgcccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtcctag

SEQ ID NO: 680 - DNA, 379 bp, Homo sapiens
gaagttcaattgttagagtctggtggcggtcttgttcagcctggtggttctttacgtctttcttgcgctgcttccggattcactttctctcgttaccctatgatttgggttcgccaagctcctggtaaaggtttggagtgggtttctggtatctctccttctggtggcaatacttattatgctgactccgttaaaggtcgcttcactatctctagagacaactctaagaatactctctacttgcagatgaacagcttaagggctgaggacaccgccatgtattactgtgcgagagggaaggtagtaccagctgctatgccctactactactacggtatggacgtctggggccaagggaccacggtcaccgtctcaagcg

SEQ ID NO: 681 - DNA, 319 bp, Homo sapiens
cagagcgctttgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtcctag

SEQ ID NO: 682 - DNA, 379 bp, Homo sapiens
gaagttcaattgttagagtctggtggcggtcttgttcagcctggtggttctttacgtctttcttgcgctgcttccggattcactttctcttcttaccatatgggttgggttcgccaagctcctggtaaaggtttggagtgggtttctcgtatcggtccttctggtggctggactacttatgctgactccgttaaaggtcgcttcactatctctagagacaactctaagaatactctctacttgcagatgaacagcttaagggctgaggacacggccgtgtattactgtgcgagagatgggtacgatttttggagtggttatcctctaggctacggtatggacgtctggggccaagggaccacggtcaccgtctcaagcg

SEQ ID NO: 683 - DNA, 325 bp, Homo sapiens
gacatccagatgacccagtctccaggcaccctgtctgtgtctctaggggaaagagccaccctctcctgcagggccagtcagagtgttagcagcaggttcttagcctggtaccagcagaaacctggccaggctcccaggctcctcatgtatggtgcatccagcagggccacaggcatcccagacaggatcagtggcagtgggtctgggacagacttcactctcaccatcagcagactggagcctgaagattttgcagtgtattactgtcagcagtatggtagctcaacgatcaccttcggccaagggacacgactggagattaaac

SEQ ID NO: 684 - DNA, 376 bp, Homo sapiens
gaagttcaattgttagagtctggtggcggtcttgttcagcctggtggttctttacgtctttcttgcgctgcttccggattcactttctctatgtaccgtatgatgtgggttcgccaagctcctggtaaaggtttggagtgggtttcttatatccgtccttctggtggcaatactggttatgctgactccgttaaaggtcgcttcactatctctagagacaactctaagaatactctctacttgcagatgaacagcttaagggctgaggacacggccgtgtattactgtgcaagaggaggtattacgatttttggagtggttattatacctgcttttgatatctggggccaagggaccacggtcaccgtctcaagcg

SEQ ID NO: 685 - DNA, 319 bp, Homo sapiens
cagagcgaattgactcagccaccctcagtgtccgtgtccccagggcagacagccagcatcacttgctctggagataaattggggaataaatatatatcttggtatcaacagaaggccggccagtcccctatggtggtcatgtatcaagatgataagcggccctcagggatccctgagcgattctctggctccaactctgggaacacagccactctgaccatcaccgggacccagactgtcgatgaggctgactatttctgtcagacgagggacttcagcagtgtgatattcggcggagggaccaagctgaccgtcctag

SEQ ID NO: 686 - DNA, 349 bp, Homo sapiens
gaagttcaattgttagagtctggtggcggtcttgttcagcctggtggttctttacgtctttcttgcgctgcttccggattcactttctcttggtacatgatgtggtgggttcgccaagctcctggtaaaggtttggagtgggtttcttctatccgttcttctggtggcaagactttttatgctgactccgttaaaggtcgcttcactatctctagagacaactctaagaatactctctacttgcagatgaacagcttaagggctgaggacacggccgtgtattactgtgcgagagatccgtacggtatggacgtctggggccaagggaccacggtcaccgtctcaagcg

SEQ ID NO: 687 - DNA, 319 bp, Homo sapiens
cagtacgaattgactcagccaccctcagtgtccgtgtccccaggacagacagccagcatcacctgctctggagatagattgggggataaatatgcttcctggtatcagcagaagccaggccagtcccctgtgttggtcatctatcaagataccaagcggccctcagggatccctgagcgattctctggctccaactctgggtccacagccactctgaccatcagcgggacccaggctatggatgaggctgactattactgtcaggcgtgggacagcagcactgtggtattcggcggagggaccaagctgaccgtcctag

SEQ ID NO: 688 - DNA, 388 bp, Homo sapiens
gaagttcaattgttagagtctggtggcggtcttgttcagcctggtggttctttacgtctttcttgcgctgcttccggattcactttctcttattacaatatgctttgggttcgccaagctcctggtaaaggtttggagtgggtttcttctatctctccttctggtggcgagactatgtatgctgactccgttaaaggtcgcttcactatctctagagacaactctaagaatactctctacttgcagatgaacagcttaagggctgaggacacggccgtgtattactgtgcgaggactcctacctactacggtgacttccttaatggggaatactactactacggtatggacgtctggggccaagggaccacggtcaccgtctcaagcg

SEQ ID NO: 689 - DNA, 319 bp, Homo sapiens
cagagcgctttgactcagccaccctcagtgtccgtgtccccaggacagacagccagcatcacctgctctggagataaattgggggataaatatgctttctggtatcagcagaagccaggccagtcccctgtgttggtcatttatcaagattccaagcggccctcagggatccctgagcgattctctggctccaactctgggaacacagccactctgaccatcagcggggcccaggctatggatgaggctgactattactgtcagacgtgggacagcggtactatggttttcggcggagggaccaagctgaccgtcctag

SEQ ID NO: 690 - DNA, 376 bp, Homo sapiens
gaagttcaattgttagagtctggtggcggtcttgttcagcctggtggttctttacgtctttcttgcgctgcttccggattcactttctctccttaccagatgtattgggttcgccaagctcctggtaaaggtttggagtgggtttcttctatctattcttctggtggcaagactgcttatgctgactccgttaaaggtcgcttcactatctctagagacaactctaagaatactctctacttgcagatgaacagcttaagggctgaggacaccgccatgtattactgtgcgagggctccccgtgggtgggagtcctactactactactacggtatggacgtctggggccaagggaccacggtcaccgtctcaagcg

SEQ ID NO: 691 - DNA, 325 bp, Homo sapiens
gacatccagatgacccagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctatgctcactttcggcggagggaccaaggtggagatcaaac

SEQ ID NO: 692 - DNA, 376 bp, Homo sapiens
gaagttcaattgttagagtctggtggcggtcttgttcagcctggtggttctttacgtctttcttgcgctgcttccggattcactttctctaagtacgagatgatttgggttcgccaagctcctggtaaaggtttggagtgggtttctcgtatctctccttctggtggcaatacttcttatgctgactccgttaaaggtcgcttcactatctctagagacaactctaagaatactctctacttgcagatgaacagcttaagggctgaggacaccgccatgtattactgtgccagagataaagggtctggctggcgccgatactactactacggtatggacgtctggggccaagggaccacggtcaccgtctcaagcg

SEQ ID NO: 693 - DNA, 325 bp, Homo sapiens
gacatccagatgacccagtctccaggcaccctgtctttgtctccaggggaaagagccaccctctcctgcagggccagtcagagtgttagcaacaacgacttagcctggtaccagcagagacctggccaggctcccaggttcctcatctatggtgcatccagcagggccactggcatccccgacaggttcagtggcagtgggtctgggacagacttcactctcaccatcagcagactggagcctgaagattttgcagtgtattactgtcagcagtatggtagctcacctccaactttcggcggagggaccaaggtggagatcaaac

SEQ ID NO: 694 - DNA, 373 bp, Homo sapiens
gaagttcaattgttagagtctggtggcggtcttgttcagcctggtggttctttacgtctttcttgcgctgcttccggattcactttctctcattaccgtatggtttgggttcgccaagctcctggtaaaggtttggagtgggtttcttctatctctccttctggtggctggactatttatgctgactccgttaaaggtcgcttcactatctctagagacaactctaagaatactctctacttgcagatgaacagcttaagggctgaggacacggccgtgtattactgtgcgaggactctgttttactatgatgatagtcacgataaatactttgaccgctggggccagggaaccctggtcaccgtctcaagcg

SEQ ID NO: 695 - DNA, 325 bp, Homo sapiens
gacatccagatgacccagtctccagccaccctgtctttgtctccaggggaaagagccaccctctcctgcagggccagtcagagtgttagcaactacttggcctggtaccagcagaaacctggccaggctcccaggctcctcatctatagtacatcttacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaac

SEQ ID NO: 696 - DNA, 358 bp, Homo sapiens
gaagttcaattgttagagtctggtggcggtcttgttcagcctggtggttctttacgtctttcttgcgctgcttccggattcactttctctccttacgctatggtttgggttcgccaagctcctggtaaaggtttggagtgggtttctgttatcggttcttctggtggcggtacttattatgctgactccgttaaaggtcgcttcactatctctagagacaactctaagaatactctctacttgcagatgaacagcttaagggctgaggacacggccgtgtattactgtgcgagactcagcattacccagggctggttcgacccctggggccagggaaccctggtcaccgtctcaagcg

SEQ ID NO: 697 - DNA, 325 bp, Homo sapiens
gacatccagatgacccagtctccagccaccctgtctgtgtctccaggggaaagagccaccctctcctgcagggccagtcagagtgttagcagcaacttagcctggtaccagcagaaacctggccaggctcccaggctcctcatgtatggtgcatccaccagggccactggtatcccagccaggttcagtggcagtgggtctgggacagagttcactctcaccatcagcagcctgcagtctgaagattttgcagtttattactgtcagcagtataataactggcctccgctcactttcggcggagggaccaaggtggagatcaaac

SEQ ID NO: 698 - DNA, 370 bp, Homo sapiens
gaagttcaattgttagagtctggtggcggtcttgttcagcctggtggttctttacgtctttcttgcgctgcttccggattcactttctctacttacgatatgaattgggttcgccaagctcctggtaaaggtttggagtgggtttctgttatcgttccttctggtggccttacttcttatgctgactccgttaaaggtcgcttcactatctctagagacaactctaagaatactctctacttgcagatgaacagcttaagggctgaggacacggccgtgtattactgtgcaagaggcggggggtatagcagcagccggtcggccggtatggacgtctggggccaagggaccacggtcaccgtctcaagcg

SEQ ID NO: 699 - DNA, 325 bp, Homo sapiens
gacatccagatgacccagtctccagccaccctgtctttgtctccaggggaaagagccaccctctcctgcagggccagtcagagtattagcagctacttagcctggtaccaacagaagcctggccaggctcccaggctcctcatctatcatgcatctaacagggccactggcatcccagccaggttcagtggcagtgggtctgggacagacttcactctcaccatcaccagcctagagcctgaagattttgcagtttattactgtcagcagcgtagcaactcgcctccgtggacgttcggccaagggaccaaggtggaaatgaaac

SEQ ID NO: 700 - DNA, 361 bp, Homo sapiens
gaagttcaattgttagagtctggtggcggtcttgttcagcctggtggttctttacgtctttcttgcgctgcttccggattcactttctctgattacaagatgatgtgggttcgccaagctcctggtaaaggtttggagtgggtttcttctatcggttcttctggtggccctacttggtatgctgactccgttaaaggtcgcttcactatctctagagacaactctaagaatactctctacttgcagatgaacagcttaagggctgaggacacggccgtgtattactgtgcgagactggcatatagcagtggctggtacgatgactactggggccagggaaccctggtcaccgtctcaagcg

SEQ ID NO: 701 - DNA, 322 bp, Homo sapiens
gacatccagatgacccagtctccagccaccctgtctttgtctccaggggaaagagccaccctctcctgcagggccagtcagagtattggcaggtacttagcctggtaccaacagaaacctggccaggctcccaggctcctcatctatgatgcatccaacagggccactggcatcccggccaggttcagtggcagtgggtctgggacagacttcactctcaccatcagcagcctagagcctgaagattttgcagtttattactgtcaacaacgtagcaagtggcctccgacgttcggccaagggaccaaggtggaaatcaagc

SEQ ID NO: 702 - DNA, 373 bp, Homo sapiens
gaagttcaattgttagagtctggtggcggtcttgttcagcctggtggttctttacgtctttcttgcgctgcttccggattcactttctctgcttacaagatgtcttgggttcgccaagctcctggtaaaggtttggagtgggtttcttctatctctccttctggtggcggtactcattatgctgactccgttaaaggtcgcttcactatctctagagacaactctaagaatactctctacttgcagatgaacagcttaagggctgaggacaccgccttgtattactgtgcaaaagatatggggggtatagcagctcgacaggcgggcggctttgggtactggggccagggaaccctggtcaccgtctcaagcg

SEQ ID NO: 703 - DNA, 328 bp, Homo sapiens
gacatccagatgacccagtctccagtcaccctgtctttgtctccaggggaaagagccaccctctcctgtagggccagtcagagttatatcagctacttagcctggtaccaacaaaaatctggccaggctcccaggctcctcatctatgatacatccaacagggccactggcatcccggccaggttcagtggcagtgggtctgggtcagacttcactctcaccatcaacagcctagagcctgaagatgttgcagtttattactgtcaacagcgtagcaactggcctccggagttcaccttcggccaagggacacgactggagattaaac

SEQ ID NO: 704 - DNA, 358 bp, Homo sapiens
gaagttcaattgttagagtctggtggcggtcttgttcagcctggtggttctttacgtctttcttgcgctgcttccggattcactttctctgtttacactatgtattgggttcgccaagctcctggtaaaggtttggagtgggtttcttggatctctccttctggtggctctactgtttatgctgactccgttaaaggtcgcttcactatctctagagacaactctaagaatactctctacttgcagatgaacagcttaagggctgaggacacggccgtgtattactgtgccgcatctcgtacaacacctggtggttttgatgtctggggccaagggacaatggtcaccgtctcaagcg

SEQ ID NO: 705 - DNA, 322 bp, Homo sapiens
gacatccagatgacccagtctccatcttccgtgtctgcatctgtaggagacagagtcaccatcacttgtcgggcgagtcaggatatcaacatctggttagcctggtatcagctgaaaccaggggaagcccctaagctcctgatccattctgcatccactttgcaaagtggggtcccatcaaggttcagcggcagtggatctgggacagatttcattttcaccatcagcagcctgcagcctgaagattatgcaacttatcattgtcaacagattaacactttcccccccactttcggcggagggaccaaggtggacatcaaac

SEQ ID NO: 706 - DNA, 352 bp, Homo sapiens
gaagttcaattgttagagtctggtggcggtcttgttcagcctggtggttctttacgtctttcttgcgctgcttccggattcactttctctgagtacgctatggagtgggttcgccaagctcctggtaaaggtttggagtgggtttcttatatctattcttctggtggctttactatttatgctgactccgttaaaggtcgcttcactatctctagagacaactctaagaatactctctacttgcagatgaacagcttaagggctgaggacacggccgtgtattactgtgcgagagatggatccgatgcttttgatatctggggccaagggacaatggtcaccgtctcaagcg

SEQ ID NO: 707 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactcgatcaccttcggccaagggacacgactggagattaaac

SEQ ID NO: 708 - DNA, 370 bp, Homo sapiens
gaagttcaattgttagagtctggtggcggtcttgttcagcctggtggttctttacgtctttcttgcgctgcttccggattcactttctctgtttacgctatgcaytgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagyg

SEQ ID NO: 709 - DNA, 337 bp, Homo sapiens; identical to SEQ ID NO: 707

SEQ ID NO: 710 - DNA, 370 bp, Homo sapiens
gaagttcaattgttagagtctggtggcggtcttgttcagcctggtggttctttacgtttttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagcg

SEQ ID NO: 711 - DNA, 337 bp, Homo sapiens
aacatccagatgacccagtctccactctccctgcccgtcacccttggacagccggcctccatctcctgcaggtctagtcaaggcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgatcaccttcggccaagggacacgactggagattaagc

SEQ ID NO: 712 - DNA, 373 bp, Homo sapiens
gaagttcaattgttagagtctggtggcggtcttgttcagcctggtggttctttacgtctttcttgcgctgcttccggattcactttctctcgttacgctatgtggtgggttcgccaagctcctggtaaaggtttggagtgggtttctggtatcgttccttctggtggccttactacttacgctgactccgttaaaggtcgcttcactatctctagagacaactctaaggatactctctacttgcagatgaacagcttaagggctgaggacacggccgtgtattactgtgcgagacatgaggtttccgagcagtggctgttcccggggaactttgactactggggccaggggaccctggtcaccgtctcaagcg

SEQ ID NO: 713 - DNA, 322 bp, Homo sapiens
aacatccagatgacccagtctccatcttccgtgtctgcatctgtaggagacagagtcaccatcacctgtcgggcgagtcagggtgttagcacctggttagcctggtatcagcagaaaccagggaaagcccctaaactcctgatctatgctgcatccagtttgcaaagtggggtcccatcgaggttcagcggcagtgggtctgggacagatttcactctcaccatcagcagcctgcagcctgaagattttgcgacttactattgtctacaggcttacaatttccctctcactttcggcggagggaccaaggtggagatcgaac

SEQ ID NO: 714 - DNA, 349 bp, Homo sapiens
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttcttatatctctccttctggtggctggacttggtacgctgacttcgttaaaggtcgcttcactatctctagagacaactctaagaatactctctacttgcagatgaacagcttaagggctgaggacacggccgtgtattactgtgcaagagttcatgatgcttttgatatctggggccaagggacaatggtcaccgtctcaagcg

SEQ ID NO: 715 - DNA, 337 bp, Homo sapiens; identical to SEQ ID NO: 707

SEQ ID NO: 716 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggacaatggtcaccgtctcaagcg

SEQ ID NO: 717 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggagactgaggatgttggggtttattactgcatgcaagctctacaaaactcgatcaccttcggccaagggacacgactggagattaaac

SEQ ID NO: 718 - DNA, 415 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgtgcaagagttcatgatgcttttgatatctggggccaagggacaatggtcaccttcaagcgcggccgcacatcatcatcaccatcacggggccgcagaacaaaaactcatctcagaagaggatctgaat

SEQ ID NO: 719 - DNA, 322 bp, Homo sapiens
aacatccagatgacccagtctccatcttccgtgtctgcatctgtaggagacagagtcaccatcacctgtcgggcgagtcagggtgttagcacctggttagcctggtatcagcagaaaccagggaaagcccctaaactcctgatctatgctgcatccagtttgcaaagtggggtcccatcgaggttcagcggcagtgggtctgggacagatttcactctcaccatcagcagcctgcagcctgaagattttgcgacttactattgtctacaggcttacaatttccctctcactttcggcggagggaccaaggtggagatcaaac

SEQ ID NO: 720 - DNA, 349 bp, Homo sapiens; identical to SEQ ID NO: 714

SEQ ID NO: 721 - DNA, 322 bp, Homo sapiens; identical to SEQ ID NO: 719

SEQ ID NO: 722 - DNA, 349 bp, Homo sapiens
gaagttcaattgttagagtctggtggcggtcttgttcagcctggtggttctttacgtctttcttgcgctgcttccggattcactttctctcattacgttatgggttgggttcgccaagctcctggtaaaggtttggagtgggtttcttatatctctccttctggtggctggacttggtatgctgacttcgttaaaggtcgcttcactatctctagagacaactctaagaatactctctacttgcagatgaacagcttaagggctgaggacacggccgtgtattactgtgcaagagttcatgatgcttttgatatctggggccaagggacaatggtcaccgtctcaagag

SEQ ID NO: 723 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcggtggcagtggatcaggcacagattttacactgaaaatcagcagagtggaggctgaggatgttggggtttattactgcatgcaagctctacaaaactcgatcaccttcggccaagggacacgactggagattaaac

SEQ ID NO: 724 - DNA, 370 bp, Homo sapiens; identical to SEQ ID NO: 507

SEQ ID NO: 725 - DNA, 337 bp, Homo sapiens
cagtacgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcgggaccgggaccaaggtcaccgtccgag

SEQ ID NO: 726 - DNA, 370 bp, Homo sapiens; identical to SEQ ID NO: 671

SEQ ID NO: 727 - DNA, 337 bp, Homo sapiens; identical to SEQ ID NO: 707

SEQ ID NO: 728 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttacctctccttctggtggctttactttttatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagcg

SEQ ID NO: 729 - DNA, 337 bp, Homo sapiens; identical to SEQ ID NO: 707

SEQ ID NO: 730 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttcttctatctctccttctggtggccagactaagtatgctgactccgttaaaggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagcg

SEQ ID NO: 731 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactcgatcaccttcggcccagggacacgactggagattaaac

SEQ ID NO: 732 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaagggtcgcttcactatctctagagacaactctaagaatactctctacttgcagatgaacagcttaagggctgaggacacggccgtgtattactgtgcaagggggggatacagctggggctactactactactacatggacgtctggggcaaagggaccacggtcaccgtctcaagcg

SEQ ID NO: 733 - DNA, 337 bp, Homo sapiens
cagtacgaattgactcagcctgcccccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcggaactgggaccaaggtcaccgtcctag

SEQ ID NO: 734 - DNA, 370 bp, Homo sapiens; identical to SEQ ID NO: 671

SEQ ID NO: 735 - DNA, 337 bp, Homo sapiens
cagtacgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcggaaccgggaccaaggtcaccgtcctag

SEQ ID NO: 736 - DNA, 370 bp, Homo sapiens
gaagttcaattgttagagtctggtggcggtcttgttcagcctggtggttctttacgtctttcttgcgctgcttccggattcactttctctgcttacggtatggattgggttcgccaagctcctggtagaggtttggagtgggtttcttctatctctccttctggtggccagactaagtatgctgactccgttaaaggtcgcttcactatctctagagacaactctaagaatactctctacttgcagatgaacagcttaagggctgaggacacggccgtgtattactgtgcgaaagaccttgggggggggtactactactactacggtatggacgtctggggccaaggcaccctggtcaccgtctcaagcg

SEQ ID NO: 737 - DNA, 337 bp, Homo sapiens
aacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacaggttttacactgaaaatcagcagagtggaggctgaggatgttggggtttattactgcatgcaagctctacaaaactcgatcaccttcggccaagggacacgactggagattaaac

SEQ ID NO: 738 - DNA, 370 bp, Homo sapiens; identical to SEQ ID NO: 507

SEQ ID NO: 739 - DNA, 337 bp, Homo sapiens
aacatccagatgacccagtctccactctccctgcccgtcacccttggacagccggcctccatctcctgcaggtctagtcaaagcctcgtatacagtgatggaaacacctacttgaattggtttcagcagaggccaggccgatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgatcaccttcggccaagggacacgactggagattaaac

SEQ ID NO: 740 - DNA, 373 bp, Homo sapiens; identical to SEQ ID NO: 661

SEQ ID NO: 741 - DNA, 337 bp, Homo sapiens; identical to SEQ ID NO: 735

SEQ ID NO: 742 - DNA, 370 bp, Homo sapiens
gaagttcaattgttagagtctggtggcggtcttgttcagcctggtggttctttacgtctttcttgcgctgcttccggattcactttctctgcttacggtatggattgggttcgccaagctcctggtaaaggtttggagtgggtttcttctatctctccttctggtggccagactaagtatgctgactccgttaaaggtcgcttcactatctctagagacaactctaagaatactctctacttgcagatgaaaagcttaagggctgaggacacggccgtgtattactgtgcgaaagaccttgggggggggtactactactactacggtatggacgtctggggccaaggcaccctggtcaccgtctcaagcg

SEQ ID NO: 743 - DNA, 337 bp, Homo sapiens
gacatccggatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactcgatcaccttcggccaagggacacgactggagattaaac

SEQ ID NO: 744 - DNA, 370 bp, Homo sapiens
gaagttcaattgttagagtctggtggcggtcttgttcagcctggtggttctttacgtctttcttgcgctgcttccggattcactttctctgtttacgctatgcattgggttcgccaagctcctggtaaaggtttggagtgggtttctgttatctctccttctggtggctttactttttatgctgactccgttaaaggtcgcttcactatctctagagacaactctaagaatactctctacttgcagatgaacagcttaagggctgaggacacggccgtgtattactgcgcaagggggggatacagctggggctactactactactacatggacgtctggggcaaagggaccacggtcaccgtctcaagcg

SEQ ID NO: 745 - DNA, 322 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgatcaccttcggccaagggacacgactggagattaaac

SEQ ID NO: 746 - DNA, 379 bp, Homo sapiens
gaagttcaattgttagagtctggtggcggtcttgttcagcctggtggttctttacgtctttcttgcgctgcttccggattcactttctcttggtacatgatgatgtgggttcgccaagctcctggtaaaggtttggagtgggtttcttatatctatccttctggtggcggtactctttatgctgactccgttaaaggtcgcttcactatctctagagacaactctaagaatactctctacttgcagatgaacagcttaagggctgaggacacggccgtgtattactgtgcgagaggagggtatgattacgtttgggggagttatcgtccgtactactttgactactggggccagggaaccctggtcaccgtctcaagcg

SEQ ID NO: 747 - DNA, 322 bp, Homo sapiens
gacatccagatgacccagtctccttccaccctgtctacatctgtaggagacagagtcaccatcacttgccgggccagtcagagtattagtacctggttggcctggtatcagcagaaaccagggaaagcccctaagctcctgatctataaggcgtctagtttagaaagtggggtcccatcaaggttcagcggcagtggatctgggacagaattcattctcaccatcagcagcctgcagcctgaagattttgcaacttattactgtctacagcataatagttacccattcactttcggccctgggaccaaagtggatatcaaac

SEQ ID NO: 748 - DNA, 319 bp, Homo sapiens
acagagcgctttgactcagccaccctcagtgtccgtgtccccaggacagacagccagcatcacctgctctggagataaattgggggataaatatgcttcctggtatcagcagaagccagaccagtcccctgtgttggtcatctatcaggataggaagaggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtccta

SEQ ID NO: 749 - DNA, 322 bp, Homo sapiens
gacatccagatgacccagtctccatcctccctgtctgcatctgtaggagacagagtcaccatcacttgccgggcaagtcagagaattaacaactatttaaattggtatcagcagacaccaggaaatgcccctaaactcctgatctatgctgcatccactttgcaagatggggtcccatcaagattcagtggcagtggatttgggacagatttcactctcaccatcagcagtctgcagcctgaagatattgcaacttacttctgtcaacagagtttcaatatcccgatcaccttcggccaagggacacgactggaaatcaaac

SEQ ID NO: 750 - DNA, 337 bp, Homo sapiens
cagtacgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcggaaccgggaccaaggtcaccgtcccag

SEQ ID NO: 751 - DNA, 370 bp, Homo sapiens
gaagttcaattgttagagtctggtggcggtcttgttcagcctggtggttctttacgtctttcttgcgctgcttccggattcactttctctgcttacggtatggattgggttcgccaagctcctggtaaaggtttggagtgggtttcttctatctctccttctggtggccagactaagtatgctgactccgttaaaggtcgcttcactatctctagagacaactctaagaatactctctacttgcagatgaacagcttaagggctgaggacacggccgtgtattactgtgcgaaagaccttgggggggggtactactactactacggtatggacgtctggggccaagggaccacggtcaccgtctcaagcg

SEQ ID NO: 752 - DNA, 337 bp, Homo sapiens; identical to SEQ ID NO: 735

SEQ ID NO: 753 - DNA, 370 bp, Homo sapiens
gaagttcaattgttagagtctggtggcggtcttgttcagcctggtggttctctacgtctttcttgcgctgcttccggattcactttctctgcttacggtatggattgggttcgccaagctcctggtaaaggtttggagtgggtttcttctatctctccttctggtggccggactaagtatgctgactccgttaaaggtcgcttcactatctctagagacaactctaagaatactctctacttgcagatgaacagcttaagggctgaggacacggccgtgtattactgtgcgaaagaccttgggggggggtactactactactacggtatggacgtctggggccaaggcaccctggtcaccgtctcaagcg

SEQ ID NO: 754 - protein, 108 aa, Homo sapiens
DIQMTQSPGTLSLSPGERATLSCRASQSVSSRYLAWYQQKPGQAPRLLIYGASSRATGIPDRFSGSGSGTDFTLTISRLEAEDFAVYYCQQYSTSPYTFGQGTKLEIK

SEQ ID NO: 755 - protein, 116 aa, Homo sapiens
EVQLLESGGGLVQPGGSLRLSCAASGFTFSRYGMHWVRQAPGKGLEWVSYIVSSGGYTEYADSVKGRFTISRDNSKNTLYLQMNSLRAEDTAVYYCTTGIAVARYWGQGTLVTVSS

SEQ ID NO: 756 - protein, 107 aa, Homo sapiens
DIQMTQSPSSLSASVGDRVTITCRASQSISGYLHWYQQKPGKAPNLLIFATSNLHSGVPSRFSGSRSGTDFTLTISSLQPEDFATYFCQQSFSTPPTFGHGTRLEIK

SEQ ID NO: 757 - protein, 117 aa, Homo sapiens
EVQLLESGGGLVQPGGSLRLSCAASGFTFSAYSMTWVRQAPGKGLEWVSGIYSSGGFTWYADSVKGRFTISRDNSKNTLYLQMNSLRAEDTAVYYCARVGLWAFDIWGQGTMVTVSS

SEQ ID NO: 758 - protein, 108 aa, Homo sapiens
DIQMTQSPSSLPASVGDRVAITCRASQSISSSYLNWYQHKPGKAPKLLIYAASNLNSGVPSRFSGSGSGTDFTLTISSLQPDDFATYYCQESHSASLTFGGGTKVEVK

SEQ ID NO: 759 - protein, 119 aa, Homo sapiens
EVQLLESGGGLVQPGGSLRLSCAASGFTFSLYKMGWVRQAPGKGLEWVSYIWSSGGWTRYADSVKGRFTISRDNSKNTLYLQMNSLRAEDTAVYYCARAGGYNSPLSYWGQGTLVTVSS

SEQ ID NO: 760 - protein, 112 aa, Homo sapiens
QYELTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFYVFGTGTKVTVL

SEQ ID NO: 761 - protein, 123 aa, Homo sapiens
EVQLLESGGGLVQPGGSLRLSCAASGFTFSAYGMDWVRQAPGKGLEWVSSISPSGGQTKYADSVKGRFTISRDNSKNTLYLQMNSLRAEDTAVYYCAKDLGGGYYYYYGMDVWGQGTLVTVSS

SEQ ID NO: 762 - protein, 107 aa, Homo sapiens
DIQMTQSPGTLSVSPGERATLSCRASQSVSNKLAWYQQKPGQAPRLLIYGASTRATGIPARFSGSGSGTEFTLTITSLQSEDFAVYYCQQRINWPLTFGGGTKVEIK

SEQ ID NO: 763 - protein, 124 aa, Homo sapiens
EVQLLESGGGLVQPGGSLRLSCAASGFTFSTYWMEWVRQAPGKGLEWVSSIVSSGGPTMYADSVKGRFTISRDNSKNTFYLQMNSLRAEDTAVYYCARAREISIFGVVKDLDIWGQGTMVTVSS

SEQ ID NO: 764 - protein, 107 aa, Homo sapiens
DIQMTQSPSSVSASVGDRVTITCRASQGVSTWLAWYQQKPGKAPKLLIYAASSLQSGVPSRFSGSGSGTDFTLTISSLQPEDFATYYCLQAYNFPLTFGGGTEVEIK

SEQ ID NO: 765 - protein, 116 aa, Homo sapiens
EVQLLESGGGLVQPGGSLRLSCAASGFTFSHYVMGWVRQAPGKGLEWVSYISPSGGWTWYADFVKGRFTISRDNSKNTLYLQMNSLRAEDTAVYYCARVHDAFDIWGQGTMVTVSS

SEQ ID NO: 766 - protein, 106 aa, Homo sapiens
QSALTQPPSVSVSPGQTASITCSGDRLGDKYASWYQQKPGQSPVLVIYQDTKRPSGIPERFSGSNSGSTATLTISGTQAMDEADYYCQAWDSSTVVFGGGTKLTVL

SEQ ID NO: 767 - protein, 127 aa, Homo sapiens
EVQLLESGGGLVQPGGSLRLSCAASGFTFSDYFMAWVRQAPGKGLEWVSSIVPSGGWTVYADSVKGRFTISRDNSKNTLYLQMNSLRAEDTAVYYCARLNGWSSGWLGYYYYGMDVWGQGTTVTVSS

SEQ ID NO: 768 - protein, 112 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQNSITFGQGTRLEIK

SEQ ID NO: 769 - protein, 123 aa, Homo sapiens
EVQLLESGGGLVQPGGSLRLSCAASGFTFSVYAMHWVRQAPGKGLEWVSVISPSGGFTFYADSVKGRFTISRDNSKNTLYLQMNSLRAEDTAVYYCARGGYSWGYYYYYMDVWGKGTTVTVSS

SEQ ID NO: 770 - protein, 112 aa, Homo sapiens
DIQMTQSPLSLPVTPGEPASISCRSSQSLLHSNGYNYLDWFLQKPGQSPQLLIYLGSHRASGVPDRFSGSGSGTDFTLKISRVEAEDVGVYYCMQALQSRYTFGQGTKLEIK

SEQ ID NO: 771 - protein, 118 aa, Homo sapiens
EVQLLESGGGLVQPGGSLRLSCAASGFTFSWYGMVWVRQAPGKGLEWVSSISPSGGSTDYADSVKGRFTISRDNSKNTLYLQMNSLRAEDTAVYYCARVGSSWYLDVWGQGTTVTVSS

SEQ ID NO: 772 - protein, 112 aa, Homo sapiens
QSELTQPRSVSGSPGQSVTISCTGTSSDVGGYNYVSWYRQDPGKAPKLIIYEVSKRPSGVSNRFSGSKSGNTASLTISGLHIEDEGLYYCSSFRYSRSLDYVFGTGTQVTVL

SEQ ID NO: 773 - protein, 123 aa, Homo sapiens
EVQLLESGGGLVQPGGSLRLSCAASGFTFSDYLMTWVRQAPGKGLEWVSGIWPSGGFTFYADSVKGRFTISRDNSKNTLYLQMNSLRAEDTAVYYCARAKGGDYGDPSPFDYWGQGTLVTVSS

SEQ ID NO: 774 - protein, 107 aa, Homo sapiens
DIQMTQSPSSVSASVGDRVTITCRASQGIGYWLAWYQQKPGNSPKLLIYVSSTLQRGVPSRFSGRGSGTDFTLTINNLQPEDFATYYCQQAKAFPLTFGGGTKVEIN

SEQ ID NO: 775 - protein, 121 aa, Homo sapiens
EVQLLESGGGLVQPGGSLRLSCAASGFTFSVYFMSWVRQAPGKGLEWVSYIGPSGGFTSYADSVKGRFTISRDNSKNTLYLQMNSLRAEDTAVYYCARVVRGYYYYGMDVWGQGTTVTVSS

SEQ ID NO: 776 - protein, 112 aa, Homo sapiens
DIQMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITFGQGTRLEIK

SEQ ID NO: 777 - protein, 124 aa, Homo sapiens
EVQLLESGGGLVQPGGSLRLSCAASGFTFSRYAMWWVRQAPGKGLEWVSGIVPSGGLTTYADSVKGRFTISRDNSKNTLYLQMNSLRAEDTAVYYCARHEVSEQWLFPGNFDYWGQGTLVTVSS

SEQ ID NO: 778 - protein, 108 aa, Homo sapiens
QSVLTQPPSASGTPGQRVTISCSGSSSNIGINPVNWYQQFPGTAPKLLIYNQRPSGVPDRFSGSKSGTSASLAISGLQSEDEADYYCAAWDDSLNGVVFGGGTKLTVL

SEQ ID NO: 779 - protein, 130 aa, Homo sapiens
EVQLLESGGGLVQPGGSLRLSCAASGFTFSYYPMVWVRQAPGKGLEWVSRISSSGGSTLYADSVKGRFTISRDNSKNTLYLQMNSLRAEDTAVYYCARGAVVPAAIEWFWSGYSNYFDYWGQGTLVTVSS

SEQ ID NO: 780 - protein, 107 aa, Homo sapiens
DIQMTQSPSSLSASVGDRVTITCRASQNINFYLSWFQQKPGKAPKLLIHSVNNLLGPVPSRFSGSGSGTDFTLTIVSLQPEDFATYYCQQGYRPPYTFGQGTKLEIK

SEQ ID NO: 781 - protein, 119 aa, Homo sapiens
EVQLLESGGGLVQPGGSLRLSCAASGFTFSWYVMMWVRQAPGKGLEWVSGISSSGGGTQYADSVKGRFTISRDNSKNTLYLQMNSLRAEDTAVYYCARGGYYYDVPYYWGQGTLVTVSS

SEQ ID NO: 782 - protein, 112 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 783 - protein, 119 aa, Homo sapiens; identical to SEQ ID NO: 781

SEQ ID NO: 784 - protein, 107 aa, Homo sapiens
RHPMTQSPLSLSASVGDRVTVTCRASQSISTYLNWYQQKPGKAPKLLIYAASSLQSGVPSRFSGSGSGTDFTLTIRSLQPDDFATYYCQQSYSSPFTFGPGTKVDFK

SEQ ID NO: 785 - protein, 117 aa, Homo sapiens
EVQLLESGGGLVQPGGSLRLSCAASGFTFSPYTMEWVRQAPGKGLEWVSSIYPSGGWTHYADSVKGRFTISRDNSKNTLYLQMNSLRAEDTAMYYCARARSACYDDWGQGTLVTVSS

SEQ ID NO: 786 - protein, 112 aa, Homo sapiens
DIQMTQSPSSLPVTPGEPASISCRSSQSLLHTNGHNYLDWYLQKPGQSPKLLIYLGSNRASGVPDRFSGSGSGTDFTLKISRVEAEDVGLYYCMQGLQIPLTFGGGTKVEIK

SEQ ID NO: 787 - protein, 119 aa, Homo sapiens
EVQLLESGGGLVQPGGSLRLSCAASGFTFSAYVMLWVRQAPGKGLEWVSYIWPSGGETKYADSVKGRFTISRDNSKNTLYLQMNSLRAEDTAVYYCARSMGYGDAFDIWGQGTMVTVSS

SEQ ID NO: 788 - protein, 107 aa, Homo sapiens
DIQMTQSPSSLSASVGDRVTITCRSSQGVRYDLGWYQQKPGKAPKLLIYGAFNLQGGVPSRFSGSGSGTDFTLTISGLQPEDFATYYCLQDFQYPFTFGPGTKVDVK

SEQ ID NO: 789 - protein, 120 aa, Homo sapiens
EVQLLESGGGLVQPGGSLRLSCAASGFTFSGYDMSWVRQAPGKGLEWVSSIWSSGGYTKYADSVKGRFTISRDNSKNTLYLQMNSLRAEDTAVYYCARQGVGGSGSLLYWGQGTLVTVSS

SEQ ID NO: 790 - protein, 106 aa, Homo sapiens
DIQMTQSPSSLSASVGDRVTVTCRASQSISSYLNWYQQKPGKAPDLLIYAASSLQSGVPSRFSGSGSGTDFTLTISSLQPEDFVTYYCQETYSALTFGGGTKVEIK

SEQ ID NO: 791 - protein, 119 aa, Homo sapiens
EVQLLESGGGLVQPGGSLRLSCAASGFTFSDYSMLWVRQAPGKGLEWVSYISSSGGPTKYADSVKGRFTISRDNSKNTLYLQMNSLRAEDTAMYYCARRHYNKRYFDYWGQGTLVTVSS

SEQ ID NO: 792 - protein, 107 aa, Homo sapiens
QSALTQPPSVSVSPGQTASITCSGDNLGDKYASWYQQKPGQSPVLVIYQDNKRPSGIPERFSGSNSGNTATLTLSRVEAGDEADYYCQVWDSSYNWVFGGGTKLTVL

SEQ ID NO: 793 - protein, 122 aa, Homo sapiens
EVQLLESGGGLVQPGGSLRLSCAASGFTFSRYNMVWVRQAPGKGLEWVSSISSSGGFTRYADSVKGRFTISRDNSKNTLYLQMNSLRAEDTAVYYCARWYSSSWYGNWFDPWGQGTLVTVSS

SEQ ID NO: 794 - protein, 107 aa, Homo sapiens
DIQMTQSPGTLSLSPGERATLSCRASQSVSSYLAWYQQKPGQAPRLLIFDASNRATGIPARFSGAGSGTDFTLTISSLEPEDFAVYYCQQRSNWPWTFGQGTKVEIK

SEQ ID NO: 795 - protein, 121 aa, Homo sapiens
EVQLLESGGGLVQPGGSLRLSCAASGFTFSKYWMAWVRQAPGKGLEWVSYISPSGGWTRYADSVKGRFTISRDNSKNTLYLQMNSLRAEDTAVYYCARVGGSYSLGALDIWGQGTMVTVSS

SEQ ID NO: 796 - protein, 107 aa, Homo sapiens [sequence omitted]

SEQ ID NO: 797 - protein, 117 aa, Homo sapiens
EVQLLESGGGLVQPGGSLRLSCAASGFTFSYYTMGWVRQAPGKGLEWVSSIWPSGGATWYADSVKGRFTISRDNSKNTLYLQMNSLRAEDTATYYCARDRDTAMADWGQGTLVTVSS

SEQ ID NO: 798 - protein, 110 aa, Homo sapiens
QSELTQPPSASGIPGQRVTISCSGSHSNIGRNYVYWYQQLPGTAPKLLIYSNNERPAGVPDRFSGSKSGTSASLAISGLRSEDEVDYYCATWDDSLSGPVFGGGTKLTVL

SEQ ID NO: 799 - protein, 117 aa, Homo sapiens
EVQLLESGGGLVQPGGSLRLSCAASGFTFSAYPMRWVRQAPGKGLEWVSYIYPSGGPTYYADSVKGRFTISRDNSKNTLYLQMNSLRAEDTAVYYCAQGVGAPVDSWGQGTLVTVSS

SEQ ID NO: 800 - protein, 110 aa, Homo sapiens
QSELTQPPSASGIPGQRVTISCSGSHSNIGRNYVYWYQQLPGTAPKLLIYSNNERPAGVPDRFSGSKSGTSASLDVSGLQSEDEADYYCASWDDSLIAWVFGGGTMLTVL

SEQ ID NO: 801 - protein, 122 aa, Homo sapiens
EVQLLESGGGLVQPGGSLRLSCAASGFTFSWYGTAWVRQAPGKGLEWVSVISPSGGPTFYADSVKGRFTISRDNSKNTLYLQMNSLRAEDMAVYYCARDSSGWRTAYYFDYWGQGTLVTVSS

SEQ ID NO: 802 - protein, 110 aa, Homo sapiens
QSALTQPPSASGTPGQRVTISCSGGYSNMGSNYAHWYQQLPGTAPKLLIYNNNQRPSGVPDRFSGSKSGTSASLAISGLRSEDEADYYCAAWDDSLSGPVFGGGTKLTVL

SEQ ID NO: 803 - protein, 122 aa, Homo sapiens
EVQLLESGGGLVQPGGSLRLSCAASGFTFSTYGMEWVRQAPGKGLEWVSSISPSGGYTGYADSVKGRFTISRDNSKNTLYLQMNSLRAEDTAVYYCAKDSLYSSSLDAFDIWGQGTMVTVSS

SEQ ID NO: 804 - protein, 108 aa, Homo sapiens
DIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK

SEQ ID NO: 805 - protein, 118 aa, Homo sapiens
EVQLLESGGGLVQPGGSLRLSCAASGFTFSSYDMIWVRQAPGKGLEWVSRIVPSGGLTGYADSVKGRFTISRDNSKNTLYLQMNSLRAEDTAVYYCARYSLWLGADYWGQGTLVTVSS

SEQ ID NO: 806 - protein, 107 aa, Homo sapiens
DIQMTQSPSTLSASVGDRVTLTCRASQSISRYLAWYQQKPGKAPKLLIYKASSLVSGFPSRFSGSGSGTEFTLTISSLQPDDSATYYCQQYNDYPGTFGQGTKLEIK

SEQ ID NO: 807 - protein, 120 aa, Homo sapiens
EVQLLESGGGLVQPGGSLRLSCAASGFTFSYYGMGWVRQAPGKGLEWVSGIWPSGGPTYYADSVKGRFTISRDNSKNTLYLQMNSLRAEDTAMYYCAKYTGSRTRVFDYWGQGTLVTVSS

SEQ ID NO: 808 - protein, 107 aa, Homo sapiens
DIQMTQSPSFLSASVGDRVTITCRASQGFGSYLAWYQQKPGKAPKLLIYAASTLQSGVPSRFSGSGSGTEFTLTISSLQPEDFATYYCQHLNSFRFTFGPGTKVDIK

SEQ ID NO: 809 - protein, 120 aa, Homo sapiens
EVQLLESGGGLVQPGGSLRLSCAASGFTFSYYEMVWVRQAPGKGLEWVSRIWPSGGYTRYADSVKGRFTISRDNSKNTLYLQMNSLRAEDTAVYYCARGVLTDPGAFDIWGQGTMVTVSS

SEQ ID NO: 810 - protein, 107 aa, Homo sapiens; identical to SEQ ID NO: 780

SEQ ID NO: 811 - protein, 126 aa, Homo sapiens
EVQLLESGGGLVQPGGSLRLSCAASGFTFSYYEMVWVRQAPGKGLEWVSRIWPSGGYTRYADSVKGRFTISRDNSKNTLYLQMNSLRAEDTAVYYCARGGYDYVWGSYRPYYFDYWGQGTLVTVSS

SEQ ID NO: 812 - protein, 106 aa, Homo sapiens
QSVLTQPPSVSVTPGQTAILSCSGDKLGDTYASWFQQKPGQSPVMVMYRGNKRPSGIPERFSGSSSGNTATLTISGTQAVDEADYYCQAWDRTTGVFGTGTRLTVL

SEQ ID NO: 813 - protein, 122 aa, Homo sapiens
EVQLLESGGGLVQPGGSLRLSCAASGFTFSTYRMVWVRQAPGKGLEWVSSIYPSGGHTGYADSVKGRFTISRDNSKNTLYLQMNSLRAEDTAVYYCARDEGSNWYSNWFDPWGQGTLVTVSS

SEQ ID NO: 814 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPYTFGQGTKLEIK

SEQ ID NO: 815 - protein, 127 aa, Homo sapiens
EVQLLESGGGLVQPGGSLRLSCAASGFTFSKYTMQWVRQAPGKGLEWVSRISSSGGATRYADSVKGRFTISRDNSKNTLYLQMNSLRAEDTAVYYCARDLGQTIFGVVIGFGGMDVWGQGTTVTVSS

SEQ ID NO: 816 - protein, 108 aa, Homo sapiens; identical to SEQ ID NO: 804

SEQ ID NO: 817 - protein, 120 aa, Homo sapiens
EVQLLESGGGLVQPGGSLRLSCAASGFTFSSYGMGWVRQAPGKGLEWVSWIYPSGGHTIYADSVKGRFTISRDNSKNTLYLQMNSLRAEDTATYYCAKDRRNYGSYFDYWGQGTLVTVSS

SEQ ID NO: 818 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYASSGARVFGTGTKVTVL

SEQ ID NO: 819 - protein, 116 aa, Homo sapiens
EVQLLESGGGLVQPGGSLRLSCAASGFTFSFYWMGWVRQAPGKGLEWVSSISSSGGKTQYADSVKGRFTISRDNSKNTLYLQMNSLRAEDTAVYYCATGIAVARYWGQGTLVTVSS

SEQ ID NO: 820 - protein, 112 aa, Homo sapiens
DIVMTQTPPSLPVNPGEPASISCRSSQSLQHSNGYNYVAWYLQKPGQSPQLLIYLGSNRASGVPDRFSGSGSGTDFKLKISRVEAEDVGDYFCMQLLETPLTFGGGTKVEIK

SEQ ID NO: 821 - protein, 118 aa, Homo sapiens
EVQLLESGGGLVQPGGSLRLSCAASGFTFSQYGMRWVRQAPGKGLEWVSSIGPSGGFTRYADSVKGRFTISRDNSKNTFYLQMNSLRAEDTAVYYCARSGSTWYFDLWGRGTLVTVSS

SEQ ID NO: 822 - protein, 107 aa, Homo sapiens
DIQMTQSPSSLSASVGDRVTITCRASQGISNYLAWYQQKPGKVPKLLIYGASTVQSGVPSRFSGSGSGTDFTLTISSLQPEDVATYYCQKYNRVPWTFGQGTKVEIK

SEQ ID NO: 823 - protein, 122 aa, Homo sapiens
EVQLLESGGGLVQPGGSLRLSCAASGFTFSKYDMDWVRQAPGKGLEWVSSISSSGGLTFYADSVKGRFTISRDNSKNTLYLQMNSLRAEDTAVYYCARHDYDFWSGHAFDIWGQGTMVTVSS

SEQ ID NO: 824 - protein, 112 aa, Homo sapiens
DIQMTQSPLSLPVTPGEPASISCRSSQSLLHRNGYNYLDWYVQRPGQSPQLLIYLGSNRASGVPDRFSGSGSGTDFTLRISRVEAEDVGVYYCMEALQTPPTFGGGTKVEIK

SEQ ID NO: 825 - protein, 122 aa, Homo sapiens
EVQLLESGGGLVQPGGSLRLSCAASGFTFSKYGMNWVRQAPGKGLEWVSGIVSSGGQTPYADSVKGRFTISRDNSKNTLYLQMNSLRAEDTAVYYCARGVRGYGDYWYFDLWGRGTLVTVSS

SEQ ID NO: 826 - protein, 112 aa, Homo sapiens
DIQMTQSPLSLPVTPGEPASISCRSSQSLLESNGYNYLDWYLQKPGQSPQLLIYLGSNRASGVPDRFSGSGSGTDFTLKISRVEAEDVGVYYCMQARQTPLTFGGGTKVEIK

SEQ ID NO: 827 - protein, 118 aa, Homo sapiens
EVQLLESGGGLVQPGGSLRLSCAASGFTFSMYGMLWVRQAPGKGLEWVSYIGPSGGATHYADSVKGRFTISRDNSKNTLYLQMNSLRAEDTAVYYCARGGPGWYFDLWGRGTLVTVSS

SEQ ID NO: 828 - protein, 107 aa, Homo sapiens
DIQMTQSPSSLSASVGDRVTITCRASQSISSYLNWYQQKPGKAPKLLMYAASSLQSGVPSRFSGSGSGTDFTLTISSLQPEDFATYYCQQSYSTPPTFGQGTKVEIK

SEQ ID NO: 829 - protein, 124 aa, Homo sapiens
EVQLLESGGGLVQPGGSLRLSCAASGFTFSAYPMAWVRQAPGKGLEWVSSISPSGGNTQYADSVKGRFTISRDNSKNTLYLQMNSLRAEDTAVYYCARGPYSSGWSHYVPFDYWGQGTLVTVSS

SEQ ID NO: 830 - protein, 107 aa, Homo sapiens
DIQMTQSPSSLSASVGDRVTITCRASQGISNYLAWYQQRPGKAPKLLIYAASSLQSGVPSRFSGSGSGTDFTLTISSLQPGDFATYYCQQSYSIPYTFGQGTKLEIK

SEQ ID NO: 831 - protein, 118 aa, Homo sapiens
EVQLLESGGGLVQPGGSLRLSCAASGFTFSGYAMGWVRQAPGKGLEWVSYIGPSGGWTRYADSVKGRFTISRDNSKNTLYLQMNSLRAEDTAVYYCARHWVSDPFDYWGQGTLVTVSS

SEQ ID NO: 832 - protein, 112 aa, Homo sapiens
DIQMTQSPLSLPVTPGEPASISCRSSQSLLDSNGYNHLDWYVQKPGQSPQLLIYLGSNRASGVPDRFSGSGSGTHFTLKISTVEAEDVGVYYCMQSLHTPQAFGQGTKVEIK

SEQ ID NO: 833 - protein, 122 aa, Homo sapiens
EVQLLESGGGLVQPGGSLRLSCAASGFTFSLYNMTWVRQAPGKGLEWVSSIGPSGGDTKYADSVKGRFTISRDNSKNTLYLQMNSLRAEDTAVYYCARVMGYYYYYYGMDVWGQGTTVTVSS

SEQ ID NO: 834 - protein, 106 aa, Homo sapiens
DIQMTQSPVTLSVSPGERATLSCRSSQPILNNLAWYQHKPGQAPRLLIYGASTRATGIPARFSGSGSGTDFTLTISSLQSEDFAVYYCQQYNNWITFGQGTRLDIK

SEQ ID NO: 835 - protein, 118 aa, Homo sapiens
EVQLLESGGGLVQPGGSLRLSCAASGFTFSYYWMDWVRQAPGKGLEWVSRIYPSGGMTWYADSVKGRFTISRDNSKNTLYLQMNSLRAEDTAVYYCARGRLNGYFDLWGRGTLVTVSS

SEQ ID NO: 836 - protein, 110 aa, Homo sapiens
QSELTQPASVSGSPGQSITISCSGTSSDVGGHNFVSWYQERPGKVPKLIIYDVNNRPSGISSRFSGSKSGNTASLTISGLQAEDEADYFCNSYTITGTYVFGTGTKVTVL

SEQ ID NO: 837 - protein, 122 aa, Homo sapiens
EVQLLESGGGLVQPGGSLRLSCAASGFTFSMYRMMWVRQAPGKGLEWVSSIRPSGGMTMYADSVKGRFTISRDNSKNTLYLQMNSLRAEDTAVYYCTRGWALFGVVRMGDYWGQGTLVTVSS

SEQ ID NO: 838 - protein, 107 aa, Homo sapiens
DIQMTQSPGTLSLSPGERATLSCRASQSVSSYLAWYQQKPGQAPRLLIYGASNRATGIPARFSGSGSGTDFTLTISSLEPEDFAVYFCQQYASPPRTFGQGTKLEMK

SEQ ID NO: 839 - protein, 116 aa, Homo sapiens
EVQLLESGGGLVQPGGSLRLSCAASGFTFSNYSMSWVRQAPGKGLEWVSSIRSSGGRTDYADSVKGRFTISRDNSKNTLYLQMNSLRAEDTAVYYCATGIAVARYWGQGTLVTVSS

SEQ ID NO: 840 - protein, 108 aa, Homo sapiens
DIQMTQSPGTLSVFPGERATLSCRASQNIGINLAWYQQKPGQTPRLLIYGASSRATGIPARFSGSGSGTEFALTISSMQSEDFAVYFCQQYHRWPPLTFGGGTKVEIK

SEQ ID NO: 841 - protein, 116 aa, Homo sapiens; identical to SEQ ID NO: 839

SEQ ID NO: 842 - protein, 111 aa, Homo sapiens
DIQMTQSPLSLPVTPGEPASISCRSSQSLLQNNGYNYLDWYLQKPGQSPQLLIFLGSNRASGVPDRFSGSGSGTDFTLRISKVEAEDVGVYYCMQALHAPTFGQGTRLEIR

SEQ ID NO: 843 - protein, 119 aa, Homo sapiens
EVQLLESGGGLVQPGGSLRLSCAASGFTFSWYGMRWVRQAPGKGLEWVSSISSSGGKTRYADSVKGRFTISRDNSKNTLYLQMNSLRAEDTAVYYCARVDQWLRSNDYWGQGTLVTVSS

SEQ ID NO: 844 - protein, 107 aa, Homo sapiens
DIQMTQSPATLSLSPGERATLSCRASQSVSNYLAWYQQKPGQSPRLLIYYASTRATGIPDRFSGSGSGTDFTLTIRRLEPEDFAVYYCQQYATSPWTFGQGTKVEIK

SEQ ID NO: 845 - protein, 119 aa, Homo sapiens
EVQLLESGGGLVQPGGSLRLSCAASGFTFSKYFMNWVRQAPGKGLEWVSSISSSGGATTYADSVKGRFTISRDNSKNTLYLQMNSLRAEDTAVYYCAKVGYTNWSIDNWGQGTLVTVSS

SEQ ID NO: 846 - protein, 108 aa, Homo sapiens; identical to SEQ ID NO: 804

SEQ ID NO: 847 - protein, 121 aa, Homo sapiens
EVQLLESGGGLVQPGGSLRLSCAASGFTFSAYWMSWVRQAPGKGLEWVSGIGPSGYTSYADSVKGRFTISRDNSKNTLYLQMNSLRAEDTAVYYCARLQVDFWSGYYFDQWGQGTLVTVSS

SEQ ID NO: 848 - protein, 107 aa, Homo sapiens
DIQMTQSPSTLSASVGDTVTITCRASQSISNWVAWYQQKPGKAPKVLIYKASLLESGVPSRFSGSQSGADFTLTISSLQPEDFAVYYCQQSGTSPFTFGPGTKVDLK

SEQ ID NO: 849 - protein, 121 aa, Homo sapiens
EVQLLESGGGLVQPGGSLRLSCAASGFTFSAYRMYWVRQAPGKGLEWVSGISPSGGKTTYADSVKGRFTISRDNSKNTLYLQMNSLRAEDTAVYYCARGRGDILTAYFDYWGQGTLVTVSS

SEQ ID NO: 850 - protein, 112 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQTFGQGTKLEIK

SEQ ID NO: 851 - protein, 118 aa, Homo sapiens
EVQLLESGGGLVQPGGSLRLSCAASGFTFSWYWMGWVRQAPGKGLEWVSSIYPSGGFTDYADSVKGRFTISRDNSKNTLYLQMNSLRAEDTAVYYCARGGDYYYMDVWGKGTTVTVSS

SEQ ID NO: 852 - protein, 110 aa, Homo sapiens
DIQMTQSPGTLSLSPGERATLSCRASQSVSSSYLAWYQQKPGQAPRLLIYGASSRATGIPDRFSGSGSETDFTLTISRLEPEDFAVYYCQQYGSSPRKYTFGQGTKLEIK

SEQ ID NO: 853 - protein, 120 aa, Homo sapiens
EVQLLESGGGLVQPGGSLRLSCAASGFTFSPYTMHWVRQAPGKGLEWVSYISPSGGWTSYADSVKGRFTISRDNSKNTLYLQMNSLRAEDTAVYYCARGQQWPGVAFEIWGQGTMVTVSS

SEQ ID NO: 854 - protein, 110 aa, Homo sapiens
QYELTQPPSASGTPGQRVTISCSGSSSNIGSNFVTWYQQLPGTAPKLLSYTNNQRPSGVPDRFSASKSGTSASLAISGLQSEDEADYYCAAWDDNLNCPVFGGGTKLTVL

SEQ ID NO: 855 - protein, 120 aa, Homo sapiens
EVQLLESGGGLVQPGGSLRLSCAASGFTFSNYGMSWVRQAPGKGLEWVSRIWPSGGYTKYADSVKGRFTISRDNSKNTLYLQMNSLRAEDTAVYYCARGKGSGSFPLDYWGQGTLVTVSS

SEQ ID NO: 856 - protein, 110 aa, Homo sapiens
QSELTQPPSASGTPGQRVTISCSGTLSNIGTNIVSWFQQLPGTAPKLLIYNDHRRPSGVPDRFSGSKSATSASLAISGLQSEDEADYYCAAWDDSLNGVVFGGGTKLTVL

SEQ ID NO: 857 - protein, 124 aa, Homo sapiens
EVQLLESGGGLVQPGGSLRLSCAASGFTFSPYAMYWVRQAPGKGLEWVSYISPSGGITQYADSVKGRFTISRDNSKNTLYLQMNSLRAEDTAVYYCARGDFDWLLHHPNAFDIWGQGTMVTVSS

SEQ ID NO: 858 - protein, 112 aa, Homo sapiens
DIQMTQSPLSLPVTPGEPASISCRSSQSLLHTHGYNYLDWFLQKPGQSPQLLIYMGSNRASGVPDRFSGSGSGTDFTLKISRVEAEDVGVYYCMQARQTPYTFGQGTKLEIK

SEQ ID NO: 859 - protein, 124 aa, Homo sapiens
EVQLLESGGGLVQPGGSLRLSCAASGFTFSDYPMQWVRQAPGKGLEWVSSIWSSGGITLYADSVKGRFTISRDNSKNTLYLQMNSLRAEDTAVYYCARGTHGGGPPWYYYMDVWGKGTTVTVSS

SEQ ID NO: 860 - protein, 112 aa, Homo sapiens
DIQMTQSPLSLSVTPGEPASISCMSSQSLLYSNGYNYLDWYLQKPGQSPQLLIYLGANRASGVPDRFSGGGSGTDFRLKISRVEAEDVGVYYCVQTLQTPYTFGQGTKLEIK

SEQ ID NO: 861 - protein, 123 aa, Homo sapiens
EVQLLESGGGLVQPGGSLRLSCAASGFTFSNYSMSWVRQAPGKGLEWVSYIYSSGGPTQYADSVKGRFTISRDNSKNTLYLQMNSLRAEDMAVYYCARGGGYSYGFPLPFDYWGQGTLVTVSS

SEQ ID NO: 862 - protein, 106 aa, Homo sapiens
DIQMTQSPSTLSASVGDRVTITCRASQNIGTWVVWYQQRPGKAPSLLIYKASTLESGVPSRFSGSGSGTEFTLTISSLQPDDFATYYCQQFYTSKTFGQGTKVEIK

SEQ ID NO: 863 - protein, 116 aa, Homo sapiens; identical to SEQ ID NO: 839

SEQ ID NO: 864 - protein, 112 aa, Homo sapiens
DIQMTQSPLSLPVTPGEPASISCRSSQSLLQSNGYNYLDWYLQKPGQSPQLLIYLGSNRASGVPDRFSGSGSGTDFTLIISRVEADDVGVYYCMQGLQTPHTFGQGTKLEIK

SEQ ID NO: 865 - protein, 118 aa, Homo sapiens
EVQLLESGGGLVQPGGSLRLSCAASGFTFSWYMMHWVRQAPGKGLEWVSSIGSSGGFTTYADSVKGRFTISRDNSKNTLYLQMNSLRAEDTAVYYCATGAMGSAFDIWGQGTMVTVSS

SEQ ID NO: 866 - protein, 108 aa, Homo sapiens
DIQMTQSPGTLSLSPGERATVSCRASQSVSSSYLAWYQQKPGLAPRLLIYDASNRATGIPDRFSGSGSGTDFTLTITRLEPEDFAVYYCQQYSTSPFTFGPGTKVDIK

SEQ ID NO: 867 - protein, 116 aa, Homo sapiens; identical to SEQ ID NO: 839

SEQ ID NO: 868 - protein, 108 aa, Homo sapiens
DIQMTQSPGTLSLSPGERATLSCRASQSVSSNYLAWYQQKPGQAPRLLMYGASTRATGVPDRFSGSGSGTEFTLTINSLQSEDFAVYYCQQYNYWPRTFGTGTKVEIK

SEQ ID NO: 869 - protein, 119 aa, Homo sapiens
EVQLLESGGGLVQPGGSLRLSCAASGFTFSKYNMFWVRQAPGKGLEWVSVIGSSGGTTGYADSVKGRFTISRDNSKNTLYLQMNSLRAEDTATYYCAREKGIAAAYDYWGQGTLVTVSS

SEQ ID NO: 870 - protein, 108 aa, Homo sapiens
DIQMTQSPGTLSLSPGERATLSCWASQSVKSNYLAWYQQKPGQAPRLLIYGASSRATGIPDRFSGSGSGTDFTLTISRLEPEDFAVYYCQQYGSSPRTFGQGTKVEIK

SEQ ID NO: 871 - protein, 118 aa, Homo sapiens
EVQLLESGGGLVQPGGSLRLSCAASGFTFSLYKMMWVRQAPGKGLEWVSSIYSSGGRTNYADSVKGRFTISRDNSKNTLYLQMNSLRAEDTAVYYCATDVTWWPRSYWGQGTLVTVSS

SEQ ID NO: 872 - protein, 112 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 873 - protein, 120 aa, Homo sapiens
EVQLLESGGGLVQPGGSLRLSCAASGFTFSMYSMHWVRQAPGKGLEWVSGISSSGGATKYADSVKGRFTISRDNSKNTLYLQMNSLRAEDTAVYYCARAAPIYNYYMDVWGKGTTVTVSS

SEQ ID NO: 874 - protein, 108 aa, Homo sapiens
DIQMTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 875 - protein, 116 aa, Homo sapiens
EVQLLESGGGLVQPGGSLRLSCAASGFTFSRYSMGWVRQAPGKGLEWVSYISSSGGVTGYADSVKGRFTISRDNSKNTLYLQMNSLRAEDTAVYYCATGIAVARYWGQGTLVTVSS

SEQ ID NO: 876 - protein, 107 aa, Homo sapiens
DIQMTQSPATLSVSPGETATLSCWASQSVKSNLAWYQQKPGQAPRLLIYGATTRATGVPARFSGSGSRTEFTLTISGLQSEDFAVYYCQQYDVWPFTFGPGTTVDIK

SEQ ID NO: 877 - protein, 114 aa, Homo sapiens
EVQLLESGGGLVQPGGSLRLSCAASGFTFSHYRMGWVRQAPGKGLEWVSYIYSSGGLTSYADSVKGRFTISRDNSKNTLYLQMNSLRAEDTAVYYCTTGALGQWGQGTLVTVSS

SEQ ID NO: 878 - protein, 107 aa, Homo sapiens
DIQMTQSPSSLSASVGDRVTITCRASQRISIYLNWYQQKPGKAPKLLIYAADNLQSGVPSRFSGSGSGTDFTLTISSLQPEDFATYYCQQSDSSPRTFGQGTKVEIK

SEQ ID NO: 879 - protein, 119 aa, Homo sapiens
EVQLLESGGGLVQPGGSLRLSCAASGFTFSGYEMQWVRQAPGKGLEWVSSIVSSGGKTYYADSVKGRFTISRDNSKNTLYLQMNSLRAEDTAVYYCARGRLVWNDLDYWGQGTLVTVSS

SEQ ID NO: 880 - protein, 109 aa, Homo sapiens
DIQMTQSPGTLSLSPGVRAALSCRASQSVSSSYLAWYQHKPGQAPRLLIYGASSRATGIPDRFSGSGSGTDFTLTISRLEPEDFAVYYCQQYGSSPPITFGQGTRLEIK

SEQ ID NO: 881 - protein, 123 aa, Homo sapiens
EVQLLESGGGLVQPGGSLRLSCAASGFTFSRYSMTWVRQAPGKGLEWVSYISPSGGDTLYADSVKGRFTISRDNSKNTLYLQMNSLRAEDTAVYYCARDWRGSSWLPTGMDVWGQGTTVTVSS

SEQ ID NO: 882 - protein, 111 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGGGTKVEIK

SEQ ID NO: 883 - protein, 123 aa, Homo sapiens
EVQLLESGGGLVQPGGSLRLSCAASGFTFSHYRMIWVRQAPGKGLEWVSSISPSGGRTGYADSVKGRFTISRDNSKNTLYLQMNSLRAEDTAVYYCARGGYDSSGYYYYFDLWGRGTLVTVSS

SEQ ID NO: 884 - protein, 111 aa, Homo sapiens
DIQMTQSPDTLSLSPGESATLSCRASESISLNSLAWYQHKPGQPPRLLIHGASYRASGIPLRFIGSGSGTGFTLTISRLEPEDSAVYYCQQYQQRSSPALTFGGGTKVEIK

SEQ ID NO: 885 - protein, 123 aa, Homo sapiens
EVQLLESGGGLVQPGGSLRLSCAASGFTFSWYHMIWVRQAPGKGLEWVSRIGPSGGFTEYADSVKGRFTISRDNSKNTLYLQMNSLRAEDTAMYYCARAYDFWSGYPSAFDIWGQGTMVTVSS

SEQ ID NO: 886 - protein, 106 aa, Homo sapiens
DIQMTQSPGTLSVSPGERATLSCRASQSVSNNLAWYQQRPGQAPRLLIYSASTRATGIPARFSGSGSGTEFTLTISSLQSEDFAIYYCQQSYSTLTFGPGTKVDIK

SEQ ID NO: 887 - protein, 118 aa, Homo sapiens
EVQLLESGGGLVQPGGSLRLSCAASGFTFSKYNMGWVRQAPGKGLEWVSGIWPSGGWTFYADSVKGRFTISRDNSKNTLYLQMNSLRAEDMAVYYCARVSEYGSFDYWGQGTLVTVSS

SEQ ID NO: 888 - protein, 107 aa, Homo sapiens
DIQMTQSPSSVSASVGDRVTITCRASQDIVTYLAWYQQTPGKAPKLLIYSASTLQSEVPSRFSGSGSGTDFTLSISSLQPEDFATYYCQQGNSFPPTFGGGTKVEIK

SEQ ID NO: 889 - protein, 120 aa, Homo sapiens
EVQLLESGGGLVQPGGSLRLSCAASGFTFSAYGMEWVRQAPGKGLEWVSYIYPSGGWTQYADSVKGRFTISRDNSKNTLYLQMNSLRAEDTAVYYCARDIPRGASAFDIWGQGTMVTVSS

SEQ ID NO: 890 - protein, 107 aa, Homo sapiens
NIQMTQSPSSVSASVGDRVTITCRASQGISSWLAWYQQKPGKAPKLLIYAASSLQSGVPSRFSGSGSGTDFTLTISSLQPEDFATYHCQQADSFPFTFGPGTKVDVK

SEQ ID NO: 891 - protein, 117 aa, Homo sapiens
EVQLLESGGGLVQPGGSLRLSCAASGFTFSGYSMVWVRQAPGKGLEWVSRISPSGGYTNYADSVKGRFTISRDNSKNTLYLQMNSLRAEDTAVYYCARDFGYGMDVWGQGTTVTVSS

SEQ ID NO: 892 - protein, 109 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSPMYTFGQGTKLEIK

SEQ ID NO: 893 - protein, 123 aa, Homo sapiens
EVQLLESGGGLVQPGGSLRLSCAASGFTFSGYNMFWVRQAPGKGLEWVSVIVPSGGLTSYADSVKGRFTISRDNSKNTLYLQMNSLRAEDTAVYYCAKDIGSSSGDYYGMDVWGQGTTVTVSS

SEQ ID NO: 894 - protein, 108 aa, Homo sapiens
DIQMTQSPGTLSVSPGERVTLSCRASQSVGSNLAWYQQKAGQAPRLLFYDASTRATGIPDRFSGSGSGRDFTLTISGLHSEDFAVYFCHHYDDWSPGTFGQGTKVEIK

SEQ ID NO: 895 - protein, 120 aa, Homo sapiens
EVQLLESGGGLVQPGGSLRLSCAASGFTFSRYAMFWVRQAPGKGLEWVSGIWSSGGFTQYADSVKGRFTISRDNSKNTLYLQMNSLRAEDTAVYYCARVRVGSTGNFDYWGQGTLVTVSS

SEQ ID NO: 896 - protein, 111 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLTFGPGTKVDIK

SEQ ID NO: 897 - protein, 124 aa, Homo sapiens
EVQLLESGGGLVQPGGSLRLSCAASGFTFSRYHMVWVRQAPGKGLEWVSSIVPSGGSTHYADSVKGRFTISRDNSKNTLYLQMNSLRAEDTAMYYCARDLGSYSSGWGGWFDPWGQGTLVTVSS

SEQ ID NO: 898 - protein, 112 aa, Homo sapiens; identical to SEQ ID NO: 872

SEQ ID NO: 899 - protein, 121 aa, Homo sapiens
EVQLLESGGGLVQPGGSLRLSCAASGFTFSPYGMSWVRQAPGKGLEWVSYIYSSGGKTHYADSVKGRFTISRDNSKNTLYLQMNSLRAEDTAVYYCARGPGGGNTYYFDYWGQGTLVTVSS

SEQ ID NO: 900 - protein, 108 aa, Homo sapiens
DIQMTQSPGTLSVSPGERATLSCRASQSIGGNLAWYQQKPGQAPRLLIYYASTRATGIPARFSGSGSGTDFALTISRLEPEDSAVYFCQHRSNWPPLTFGQGTKVEVK

SEQ ID NO: 901 - protein, 120 aa, Homo sapiens
EVQLLESGGGLVQPGGSLRLSCAASGFTFSRYAMGWVRQAPGKGLEWVSYISPSGGMTWYADSVKGRFTISRDNSKNTLYLQMNSLRAEDTAVYYCARDRRIFDYAFDIWGQGTTVTVSS

SEQ ID NO: 902 - protein, 107 aa, Homo sapiens
DIQMTQSPATLSASVGDRVTITCRTSQTISHYLNWYQQKPGRAPKLLIYAISNLQSGVPSRFSGSGSGTDFTLTISSLQPEDFATYYCQKYNSAPYTFGQGTKLEIK

SEQ ID NO: 903 - protein, 125 aa, Homo sapiens
EVQLLESGGGLVQPGGSLRLSCAASGFTFSYYIMHWVRQAPGKGLEWVSGISPSGGITVYADSVKGRFTISRDNSKNTLYLQMNSLRAEDTAVYYCALRGVPAARDYYYYYMDVWGKGTTVTVSS

SEQ ID NO: 904 - protein, 112 aa, Homo sapiens
DIQMTQSPLSLPVTPGEPASISCRSSQSLLHTNGYNYLDWYLQKPGQSPQLLIYLGSYRASGVPDRFSGGGSGTDFTLKISRVEADDVGVYYCMQGLQTPITFGPGTRLGIK

SEQ ID NO: 905 - protein, 119 aa, Homo sapiens
EVQLLESGGGLVQPGGSLRLSCAASGFTFSGYSMVWVRQAPGKGLEWVSYIGSSGGKTMYADSVKGRFTISRDNSKNTLYLQMNSLRAEDTAVYYCARAAPSGWYYDYWGQGTLVTVSS

SEQ ID NO: 906 - protein, 108 aa, Homo sapiens
DIQMTQSPGTLSLSPGERATLSCRASQTVSSAYLAWYQQRPGQAPRLLIYGASSRATGVPDRFSGSGSGTDFTLTINRLEPEDFAVYYCQQFGVSSWTFGQGTKVEIK

SEQ ID NO: 907 - protein, 118 aa, Homo sapiens
EVQLLESGGGLVQPGGSLRLSCAASGFTFSIYNMYWVRQAPGKGLEWVSGIRPSGGPTTYADSVKGRFTISRDNSKNTLYLQMNSLRAEDTAVYYCARAKWGWYFDLWGRGTLVTVSS

SEQ ID NO: 908 - protein, 107 aa, Homo sapiens
DIQMTQSPSSLSASVGDRVTITCRASQSIGTYLNWYQQKPGTPPKLLMYAASRLQPGVPSRFSGSGSLTEFTLTISNLQPEDFASYYCQQSYIAPPTFGGGTKVEIK

SEQ ID NO: 909 - protein, 128 aa, Homo sapiens
EVQLLESGGGLVQPGGSLRLSCAASGFTFSRYVMGWVRQAPGKGLEWVSYIGPSGGYTLYADSVKGRFTISRDNSKNTLYLQMNSLRAEDTAVYYCARDKYYGSGSYPRYYYYYMDVWGKGTTVTVSS

SEQ ID NO: 910 - protein, 111 aa, Homo sapiens
DIQMTQSPLSLPVTPGEPASISCRSSQSLLHGNGYNYLDWYLQKPGQSPQLLVYLGSNRASGVPDRFSGSGSGTDFTLQISRVEAEDVGVYYCMQALQTPTFGGGTKVEIK

SEQ ID NO: 911 - protein, 121 aa, Homo sapiens
EVQLLESGGGLVQPGGSLRLSCAASGFTFSHYGMMWVRQAPGKGLEWVSSIWPSGGKTDYADSVKGRFTISRDNSKNTLYLQMNSLRAEDTAVYYCARGTTVWWNYYMDVWGKGTTVTVSS

SEQ ID NO: 912 - protein, 109 aa, Homo sapiens
DIQMTQSPGTLSLSPGERATLSCRASQSVSSSYLAWYQQKPGQAPRLLIYGASSRATGIPDRFSGSGSGTDFTLTISRLEPEDFAVYYCQQYGISPPYSFGQGTKLEIK

SEQ ID NO: 913 - protein, 118 aa, Homo sapiens
EVQLLESGGGLVQPGGSLRLSCAASGFTFSIYAMGWVRQAPGKGLEWVSGIVPSGGPTNYADSVKGRFTISRDNSKNTLYLQMNSLRAEDTAVYYCARIMWYGQFDYWGQGTLVTVSS

SEQ ID NO: 914 - protein, 107 aa, Homo sapiens
DIQMTQSPSSLSASVGDRVTITCRASQSISSYLNWYQKRPGKAPNLLIYGADTLQTGVPSRFSGDGSGTDFTLTINSLQPEDFATYYCQQSYSTSWTFGQGTKVEVR

SEQ ID NO: 915 - protein, 118 aa, Homo sapiens
EVQLLESGGGLVQPGGSLRLSCAASGFTFSGYVMSWVRQAPGKGLEWVSSIGPSGGTTKYADSVKGRFTISRDNSKNTLYLQMNSLRAEDTATYYCAKDRGLYYFDYWGQGTLVTVSS

SEQ ID NO: 916 - protein, 113 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKVEIK

SEQ ID NO: 917 - protein, 122 aa, Homo sapiens
EVQLLESGGGLVQPGGSLRLSCAASGFTFSSYTMIWVRQAPGKGLEWVSRISPSGGHTEYADSVKGRFTISRDNSKNTLYLQMNSLRAEDTAVYYCAGHYGSGSYYASLDYWGQGTLVTVSS

SEQ ID NO: 918 - protein, 112 aa, Homo sapiens
DIQMTQSPLSLPVTPGEPASISCKSSQSLLHFNGYSYLDWYLQKPGQSPQLLIYLASNRASGVPDRFSGSGSGTDFTLNISRVEAEDVGVYYCMQALQTPLTFGEGTKVQMK

SEQ ID NO: 919 - protein, 120 aa, Homo sapiens
EVQLLESGGGLVQPGGSLRLSCAASGFTFSGYAMQWVRQAPGKGLEWVSSISPSGGDTSYADSVKGRFTISRDNSKNTLYLQMNSLRAEDTAVYYCTRSGTGYYYYMDVWGKGTTVTVSS

SEQ ID NO: 920 - protein, 112 aa, Homo sapiens
NIQMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITFGQGTRLEIK

SEQ ID NO: 921 - protein, 116 aa, Homo sapiens
EVQLLESGGGLVQPGGSLRLSCAASGFTFSRYAMWWVRQAPGKGLEWVSGIVPSGGLTTYADSVKGRFTISRDNSKNTLYLQMNSLRAEDTAVYYCARVHDAFDIWGQGTMVTVSS

SEQ ID NO: 922 - protein, 112 aa, Homo sapiens
NIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQNSITFGQGTRLEIK

SEQ ID NO: 923 - protein, 124 aa, Homo sapiens; identical to SEQ ID NO: 777

SEQ ID NO: 924 - protein, 112 aa, Homo sapiens; identical to SEQ ID NO: 920

SEQ ID NO: 925 - protein, 124 aa, Homo sapiens; identical to SEQ ID NO: 777

SEQ ID NO: 926 - protein, 112 aa, Homo sapiens
NIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPITFGQGTRLEIK

SEQ ID NO: 927 - protein, 117 aa, Homo sapiens
EVQLLESGGGLVQPGGSLRLSCAASGFTFSAYGMDWVRQAPGKGLEWVSSIPPSGGQTKYADSVKGRFTISRDNSKNTLYLQMNSLRAEDTAVYYCARVGLWAFDIWGQGTMVTVSS

SEQ ID NO: 928 - protein, 112 aa, Homo sapiens
NIQMTQSPLSLPVTLGQPASISCRSSQSLLHSNGYNYLDWYLQKPGQSPQLLIYLGSNRASGVPDRFSGSGSGTDFTLKISRVEAEDVGVYYCMQALQNSITFGQGTRLEIK

SEQ ID NO: 929 - protein, 121 aa, Homo sapiens
EVQLLEFGGGLVQPGGSLRLSCAASGFTFSVYAMHWVRQAPGKGLEWVSVISPSGGFTFYADSVKGRFTISRDNSKNTLYLQMNSLRAEDTAVYYCARVVRGYYYYGMDVWGQGTTVTVSS

SEQ ID NO: 930 - protein, 112 aa, Homo sapiens; identical to SEQ ID NO: 928

SEQ ID NO: 931 - protein, 124 aa, Homo sapiens; identical to SEQ ID NO: 777

SEQ ID NO: 932 - protein, 112 aa, Homo sapiens; identical to SEQ ID NO: 920

SEQ ID NO: 933 - protein, 123 aa, Homo sapiens; identical to SEQ ID NO: 761

SEQ ID NO: 934 - protein, 123 aa, Homo sapiens; identical to SEQ ID NO: 761

SEQ ID NO: 935 - protein, 112 aa, Homo sapiens
DIQMTQSPLSLPVTPGEPASISCRSSQSLLHSNGYNYLDWYLQKPGQSPQLLIYLGSNRASGVPDRFSGSGSGTDFTLKISRVEAEDVRVYYCMQALQNSITFGQGTRLEIK

SEQ ID NO: 936 - protein, 121 aa, Homo sapiens
EVHLLESGGGLVQPGGSLRLSCAASGFTFSVYFMSWVRQAPGKGLEWVSYIGPSGGFTSYADSVKGRFTISRDNSKNTLYLQMNSLRAEDTAVYYCARVVRGYYYYGMDVWGQGTTVTVSS

SEQ ID NO: 937 - protein, 107 aa, Homo sapiens
QSALTQPPSLSVSPGQTATITCSGDKLGDKYTSWYQQRPGQSPVLVLYKDNKRPSGIPQRFSGSNSGNTATLTISGTQAVDEADYYCQAWDSKEFYVFGTGTKVTVL

SEQ ID NO: 938 - protein, 126 aa, Homo sapiens
EVQLLESGGGLVQPGGSLRLSCAASGFTFSIYKMHWVRQAPGKGLEWVSSIVSSGGATQYADSVKGRFTISRDNSKNTLYLQMNSLRAEDTAVYYCARVGWVLRFLEWLPDSFDYWGQGTLVTVSS

SEQ ID NO: 939 - protein, 106 aa, Homo sapiens
QYELTQPPSVSVSPGQTAIITCSGDRLGDKYASWYQQKPGQSPVLVIYQDTKRPSGIPERFSGSNSGDTATLTISGTQAMDDADYYCHSWDSRTGIFGGGTKLTVL

SEQ ID NO: 940 - protein, 131 aa, Homo sapiens
EVQLLESGGGLVQPGGSLRLSCAASGFTFSKYNMHWVRQAPGKGLEWVSSISSSGGNTDYADSVKGRFTISRDNSKNTLYLQMNSLRAEDTATYYCARVFPFRDGYNYWFGGDSRDAFDIWGQGTMVTVSS

SEQ ID NO: 941 - protein, 106 aa, Homo sapiens
QSALTQPPSVSVSPGQTASITCSADKLGDRYASWYQQKPGQSPVLVIYQDSKRPSGIPERFSGSNSGNTATLTISGTQAMDEADYYCQAWDSSTAVFGGGTKLTVL

SEQ ID NO: 942 - protein, 126 aa, Homo sapiens
EVQLLESGGGLVQPGGSLRLSCAASGFTFSRYPMIWVRQAPGKGLEWVSGISPSGGNTYYADSVKGRFTISRDNSKNTLYLQMNSLRAEDTAMYYCARGKVVPAAMPYYYYGMDVWGQGTTVTVSS

SEQ ID NO: 943 - protein, 106 aa, Homo sapiens
QSALTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 944 - protein, 126 aa, Homo sapiens
EVQLLESGGGLVQPGGSLRLSCAASGFTFSSYHMGWVRQAPGKGLEWVSRIGPSGGWTTYADSVKGRFTISRDNSKNTLYLQMNSLRAEDTAVYYCARDGYDFWSGYPLGYGMDVWGQGTTVTVSS

SEQ ID NO: 945 - protein, 108 aa, Homo sapiens
DIQMTQSPGTLSVSLGERATLSCRASQSVSSRFLAWYQQKPGQAPRLLMYGASSRATGIPDRISGSGSGTDFTLTISRLEPEDFAVYYCQQYGSSTITFGQGTRLEIK

SEQ ID NO: 946 - protein, 125 aa, Homo sapiens
EVQLLESGGGLVQPGGSLRLSCAASGFTFSMYRMMWVRQAPGKGLEWVSYIRPSGGNTGYADSVKGRFTISRDNSKNTLYLQMNSLRAEDTAVYYCARGGITIFGVVIIPAFDIWGQGTTVTVSS

SEQ ID NO: 947 - protein, 106 aa, Homo sapiens
QSELTQPPSVSVSPGQTASITCSGDKLGNKYISWYQQKAGQSPMVVMYQDDKRPSGIPERFSGSNSGNTATLTITGTQTVDEADYFCQTRDFSSVIFGGGTKLTVL

SEQ ID NO: 948 - protein, 116 aa, Homo sapiens
EVQLLESGGGLVQPGGSLRLSCAASGFTFSWYMMWWVRQAPGKGLEWVSSIRSSGGKTFYADSVKGRFTISRDNSKNTLYLQMNSLRAEDTAVYYCARDPYGMDVWGQGTTVTVSS

SEQ ID NO: 949 - protein, 106 aa, Homo sapiens
QYELTQPPSVSVSPGQTASITCSGDRLGDKYASWYQQKPGQSPVLVIYQDTKRPSGIPERFSGSNSGSTATLTISGTQAMDEADYYCQAWDSSTVVFGGGTKLTVL

SEQ ID NO: 950 - protein, 129 aa, Homo sapiens
EVQLLESGGGLVQPGGSLRLSCAASGFTFSYYNMLWVRQAPGKGLEWVSSISPSGGETMYADSVKGRFTISRDNSKNTLYLQMNSLRAEDTAVYYCARTPTYYGDFLNGEYYYYGMDVWGQGTTVTVSS

SEQ ID NO: 951 - protein, 106 aa, Homo sapiens
QSALTQPPSVSVSPGQTASITCSGDKLGDKYAFWYQQKPGQSPVLVIYQDSKRPSGIPERFSGSNSGNTATLTISGAQAMDEADYYCQTWDSGTMVFGGGTKLTVL

SEQ ID NO: 952 - protein, 125 aa, Homo sapiens
EVQLLESGGGLVQPGGSLRLSCAASGFTFSPYQMYWVRQAPGKGLEWVSSIYSSGGKTAYADSVKGRFTISRDNSKNTLYLQMNSLRAEDTAMYYCARAPRGWESYYYYYGMDVWGQGTTVTVSS

SEQ ID NO: 953 - protein, 108 aa, Homo sapiens
DIQMTQSPATLSLSPGERATLSCRASQSVGSYLAWYQQKPGQAPRLLIYDASNRATGIPARFSGSGSGTDFTLTISSLEPEDFAVYYCQQRSNWPMLTFGGGTKVEIK

SEQ ID NO: 954 - protein, 125 aa, Homo sapiens
EVQLLESGGGLVQPGGSLRLSCAASGFTFSKYEMIWVRQAPGKGLEWVSRISPSGGNTSYADSVKGRFTISRDNSKNTLYLQMNSLRAEDTAMYYCARDKGSGWRRYYYYGMDVWGQGTTVTVSS

SEQ ID NO: 955 - protein, 108 aa, Homo sapiens
DIQMTQSPGTLSLSPGERATLSCRASQSVSNNDLAWYQQRPGQAPRFLIYGASSRATGIPDRFSGSGSGTDFTLTISRLEPEDFAVYYCQQYGSSPPTFGGGTKVEIK

SEQ ID NO: 956 - protein, 124 aa, Homo sapiens
EVQLLESGGGLVQPGGSLRLSCAASGFTFSHYRMVWVRQAPGKGLEWVSSISPSGGWTIYADSVKGRFTISRDNSKNTLYLQMNSLRAEDTAVYYCARTLFYYDDSHDKYFDRWGQGTLVTVSS

SEQ ID NO: 957 - protein, 108 aa, Homo sapiens
DIQMTQSPATLSLSPGERATLSCRASQSVSNYLAWYQQKPGQAPRLLIYSTSYRATGIPARFSGSGSGTDFTLTISSLEPEDFAVYYCQQRSNWPPWTFGQGTKVEIK

SEQ ID NO: 958 - protein, 119 aa, Homo sapiens
EVQLLESGGGLVQPGGSLRLSCAASGFTFSPYAMVWVRQAPGKGLEWVSVIGSSGGGTYYADSVKGRFTISRDNSKNTLYLQMNSLRAEDTAVYYCARLSITQGWFDPWGQGTLVTVSS

SEQ ID NO: 959 - protein, 108 aa, Homo sapiens
DIQMTQSPATLSVSPGERATLSCRASQSVSSNLAWYQQKPGQAPRLLMYGASTRATGIPARFSGSGSGTEFTLTISSLQSEDFAVYYCQQYNNWPPLTFGGGTKVEIK

SEQ ID NO: 960 - protein, 123 aa, Homo sapiens
EVQLLESGGGLVQPGGSLRLSCAASGFTFSTYDMNWVRQAPGKGLEWVSVIVPSGGLTSYADSVKGRFTISRDNSKNTLYLQMNSLRAEDTAVYYCARGGGYSSSRSAGMDVWGQGTTVTVSS

SEQ ID NO: 961 - protein, 108 aa, Homo sapiens
DIQMTQSPATLSLSPGERATLSCRASQSISSYLAWYQQKPGQAPRLLIYHASNRATGIPARFSGSGSGTDFTLTITSLEPEDFAVYYCQQRSNSPPWTFGQGTKVEMK

SEQ ID NO: 962 - protein, 120 aa, Homo sapiens
EVQLLESGGGLVQPGGSLRLSCAASGFTFSDYKMMWVRQAPGKGLEWVSSIGSSGGPTWYADSVKGRFTISRDNSKNTLYLQMNSLRAEDTAVYYCARLAYSSGWYDDYWGQGTLVTVSS

SEQ ID NO: 963 - protein, 107 aa, Homo sapiens
DIQMTQSPATLSLSPGERATLSCRASQSIGRYLAWYQQKPGQAPRLLIYDASNRATGIPARFSGSGSGTDFTLTISSLEPEDFAVYYCQQRSKWPPTFGQGTKVEIK

SEQ ID NO: 964 - protein, 124 aa, Homo sapiens
EVQLLESGGGLVQPGGSLRLSCAASGFTFSAYKMSWVRQAPGKGLEWVSSISPSGGGTHYADSVKGRFTISRDNSKNTLYLQMNSLRAEDTALYYCAKDMGGIAARQAGGFGYWGQGTLVTVSS

SEQ ID NO: 965 - protein, 109 aa, Homo sapiens
DIQMTQSPVTLSLSPGERATLSCRASQSYISYLAWYQQKSGQAPRLLIYDTSNRATGIPARFSGSGSGSDFTLTINSLEPEDVAVYYCQQRSNWPPEFTFGQGTRLEIK

SEQ ID NO: 966 - protein, 119 aa, Homo sapiens
EVQLLESGGGLVQPGGSLRLSCAASGFTFSVYTMYWVRQAPGKGLEWVSWISPSGGSTVYADSVKGRFTISRDNSKNTLYLQMNSLRAEDTAVYYCAASRTTPGGFDVWGQGTMVTVSS

SEQ ID NO: 967 - protein, 107 aa, Homo sapiens
DIQMTQSPSSVSASVGDRVTITCRASQDINIWLAWYQLKPGEAPKLLIHSASTLQSGVPSRFSGSGSGTDFIFTISSLQPEDYATYHCQQINTFPPTFGGGTKVDIK

SEQ ID NO: 968 - protein, 117 aa, Homo sapiens
EVQLLESGGGLVQPGGSLRLSCAASGFTFSEYAMEWVRQAPGKGLEWVSYIYSSGGFTIYADSVKGRFTISRDNSKNTLYLQMNSLRAEDTAVYYCARDGSDAFDIWGQGTMVTVSS

SEQ ID NO: 969 - protein, 112 aa, Homo sapiens; identical to SEQ ID NO: 922

SEQ ID NO: 970 - protein, 123 aa, Homo sapiens; identical to SEQ ID NO: 769

SEQ ID NO: 971 - protein, 112 aa, Homo sapiens; identical to SEQ ID NO: 922

SEQ ID NO: 972 - protein, 123 aa, Homo sapiens
EVQLLESGGGLVQPGGSLRFSCAASGFTFSVYAMHWVRQAPGKGLEWVSVISPSGGFTFYADSVKGRFTISRDNSKNTLYLQMNSLRAEDTAVYYCARGGYSWGYYYYYMDVWGKGTTVTVSS

SEQ ID NO: 973 - protein, 112 aa, Homo sapiens
NIQMTQSPLSLPVTLGQPASISCRSSQGLVYSDGNTYLNWFQQRPGQSPRRLIYKVSNRDSGVPDRFSGSGSGTDFTLKISRVEAEDVGVYYCMQGTHWPITFGQGTRLEIK

SEQ ID NO: 974 - protein, 124 aa, Homo sapiens
EVQLLESGGGLVQPGGSLRLSCAASGFTFSRYAMWWVRQAPGKGLEWVSGIVPSGGLTTYADSVKGRFTISRDNSKDTLYLQMNSLRAEDTAVYYCARHEVSEQWLFPGNFDYWGQGTLVTVSS

SEQ ID NO: 975 - protein, 107 aa, Homo sapiens
NIQMTQSPSSVSASVGDRVTITCRASQGVSTWLAWYQQKPGKAPKLLIYAASSLQSGVPSRFSGSGSGTDFTLTISSLQPEDFATYYCLQAYNFPLTFGGGTKVEIE

SEQ ID NO: 976 - protein, 116 aa, Homo sapiens
EVQLLESGGGLVQPGGSLRLSCAASGFTFSRYVMGWVRQAPGKGLEWVSYISPSGGWTWYADFVKGRFTISRDNSKNTLYLQMNSLRAEDTAVYYCARVHDAFDIWGQGTMVTVSS

SEQ ID NO: 977 - protein, 112 aa, Homo sapiens; identical to SEQ ID NO: 922

SEQ ID NO: 978 - protein, 123 aa, Homo sapiens
EVQLLESGGGLVQPGGSLRLSCAASGFTFSVYAMHWVRQAPGKGLEWVSVISPSGGFTFYADSVKGRFTISRDNSKNTLYLQMNSLRAEDTAVYYCARGGYSWGYYYYYMDVWGKGTMVTVSS

SEQ ID NO: 979 - protein, 112 aa, Homo sapiens
NIQMTQSPLSLPVTPGEPASISCRSSQSLLHSNGYNYLDWYLQKPGQSPQLLIYLGSNRASGVPDRFSGSGSGTDFTLKISRVETEDVGVYYCMQALQNSITFGQGTRLEIK

SEQ ID NO: 980 - protein, 138 aa, Homo sapiens
EVQLLESGGGLVQPGGSLRLSCAASGFTFSVYAMHWVRQAPGKGLEWVSVISPSGGFTFYADSVKGRFTISRDNSKNTLYLQMNSLRAEDTAVYYCARVHDAFDIWGQGTMVTFKRGRTSSSPSRGRRTKTHLRRGSE

SEQ ID NO: 981 - protein, 107 aa, Homo sapiens
NIQMTQSPSSVSASVGDRVTITCRASQGVSTWLAWYQQKPGKAPKLLIYAASSLQSGVPSRFSGSGSGTDFTLTISSLQPEDFATYYCLQAYNFPLTFGGGTKVEIK

SEQ ID NO: 982 - protein, 116 aa, Homo sapiens; identical to SEQ ID NO: 976

SEQ ID NO: 983 - protein, 107 aa, Homo sapiens; identical to SEQ ID NO: 981

SEQ ID NO: 984 - protein, 116 aa, Homo sapiens
EVQLLESGGGLVQPGGSLRLSCAASGFTFSHYVMGWVRQAPGKGLEWVSYISPSGGWTWYADFVKGRFTISRDNSKNTLYLQMNSLRAEDTAVYYCARVHDAFDIWGQGTMVTVSR

SEQ ID NO: 985 - protein, 112 aa, Homo sapiens
NIQMTQSPLSLPVTPGEPASISCRSSQSLLHSNGYNYLDWYLQKPGQSPQLLIYLGSNRASGVPDRFGGSGSGTDFTLKISRVEAEDVGVYYCMQALQNSITFGQGTRLEIK

SEQ ID NO: 986 - protein, 123 aa, Homo sapiens; identical to SEQ ID NO: 769

SEQ ID NO: 987 - protein, 112 aa, Homo sapiens
QYELTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFYVFGTGTKVTVR

SEQ ID NO: 988 - protein, 123 aa, Homo sapiens; identical to SEQ ID NO: 761

SEQ ID NO: 989 - protein, 112 aa, Homo sapiens; identical to SEQ ID NO: 922

SEQ ID NO: 990 - protein, 123 aa, Homo sapiens
EVQLLESGGGLVQPGGSLRLSCAASGFTFSVYAMHWVRQAPGKGLEWVSVTSPSGGFTFYADSVKGRFTISRDNSKNTLYLQMNSLRAEDTAVYYCARGGYSWGYYYYYMDVWGKGTTVTVSS

SEQ ID NO: 991 - protein, 112 aa, Homo sapiens; identical to SEQ ID NO: 922

SEQ ID NO: 992 - protein, 123 aa, Homo sapiens
EVQLLESGGGLVQPGGSLRLSCAASGFTFSVYAMHWVRQAPGKGLEWVSSISPSGGQTKYADSVKGRFTISRDNSKNTLYLQMNSLRAEDTAVYYCARGGYSWGYYYYYMDVWGKGTTVTVSS

SEQ ID NO: 993 - protein, 112 aa, Homo sapiens
NIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQNSITFGPGTRLEIK

SEQ ID NO: 994 - protein, 123 aa, Homo sapiens; identical to SEQ ID NO: 769

SEQ ID NO: 995 - protein, 112 aa, Homo sapiens
QYELTQPAPVSGSPGQSITISCTGTSSDVGGYNYVSWYQQHPGKAPKLMIYEVSNRPSGVSNRFSGSKSGNTASLTISGLQAEDEADYYCSSYTSSSTLFYVFGTGTKVTVL

SEQ ID NO: 996 - protein, 123 aa, Homo sapiens; identical to SEQ ID NO: 761

SEQ ID NO: 997 - protein, 112 aa, Homo sapiens; identical to SEQ ID NO: 760

SEQ ID NO: 998 - protein, 123 aa, Homo sapiens
EVQLLESGGGLVQPGGSLRLSCAASGFTFSAYGMDWVRQAPGRGLEWVSSISPSGGQTKYADSVKGRFTISRDNSKNTLYLQMNSLRAEDTAVYYCAKDLGGGYYYYYGMDVWGQGTLVTVSS

SEQ ID NO: 999 - protein, 112 aa, Homo sapiens
NIQMTQSPLSLPVTPGEPASISCRSSQSLLHSNGYNYLDWYLQKPGQSPQLLIYLGSNRASGVPDRFSGSGSGTGFTLKISRVEAEDVGVYYCMQALQNSITFGQGTRLEIK

SEQ ID NO: 1000 - protein, 123 aa, Homo sapiens; identical to SEQ ID NO: 769

SEQ ID NO: 1001 - protein, 112 aa, Homo sapiens
NIQMTQSPLSLPVTLGQPASISCRSSQSLVYSDGNTYLNWFQQRPGRSPRRLIYKVSNRDSGVPDRFSGSGSGTDFTLKISRVEAEDVGVYYCMQGTHWPITFGQGTRLEIK

SEQ ID NO: 1002 - protein, 124 aa, Homo sapiens; identical to SEQ ID NO: 777

SEQ ID NO: 1003 - protein, 112 aa, Homo sapiens; identical to SEQ ID NO: 760

SEQ ID NO: 1004 - protein, 123 aa, Homo sapiens
EVQLLESGGGLVQPGGSLRLSCAASGFTFSAYGMDWVRQAPGKGLEWVSSISPSGGQTKYADSVKGRFTISRDNSKNTLYLQMKSLRAEDTAVYYCAKDLGGGYYYYYGMDVWGQGTLVTVSS

SEQ ID NO: 1005 - protein, 112 aa, Homo sapiens
DIRMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQNSITFGQGTRLEIK

SEQ ID NO: 1006 - protein, 123 aa, Homo sapiens; identical to SEQ ID NO: 769

SEQ ID NO: 1007 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPITFGQGTRLEIK

SEQ ID NO: 1008 - protein, 126 aa, Homo sapiens
EVQLLESGGGLVQPGGSLRLSCAASGFTFSWYMMMWVRQAPGKGLEWVSYIYPSGGGTLYADSVKGRFTISRDNSKNTLYLQMNSLRAEDTAVYYCARGGYDYVWGSYRPYYFDYWGQGTLVTVSS

SEQ ID NO: 1009 - protein, 107 aa, Homo sapiens
DIQMTQSPSTLSTSVGDRVTITCRASQSISTWLAWYQQKPGKAPKLLIYKASSLESGVPSRFSGSGSGTEFILTISSLQPEDFATYYCLQHNSYPFTFGPGTKVDIK

SEQ ID NO: 1010 - protein, 100 aa, Homo sapiens
TERFDSATLSVRVPRTDSQHHLLWRIGGICFLVSAEARPVPCVGHLSGEEALRDPAILWLQLWEHSHSDHQRDPGYGGLLLSGVGQQHCGIRRRDQADRP

SEQ ID NO: 1011 - protein, 107 aa, Homo sapiens
DIQMTQSPSSLSASVGDRVTITCRASQRINNYLNWYQQTPGNAPKLLIYAASTLQDGVPSRFSGSGFGTDFTLTISSLQPEDIATYFCQQSFNIPITFGQGTRLEIK

SEQ ID NO: 1012 - protein, 112 aa, Homo sapiens
QYELTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFYVFGTGTKVTVP

SEQ ID NO: 1013 - protein, 123 aa, Homo sapiens
EVQLLESGGGLVQPGGSLRLSCAASGFTFSAYGMDWVRQAPGKGLEWVSSISPSGGQTKYADSVKGRFTISRDNSKNTLYLQMNSLRAEDTAVYYCAKDLGGGYYYYYGMDVWGQGTTVTVSS

SEQ ID NO: 1014 - protein, 112 aa, Homo sapiens; identical to SEQ ID NO: 760

SEQ ID NO: 1015 - protein, 123 aa, Homo sapiens
EVQLLESGGGLVQPGGSLRLSCAASGFTFSAYGMDWVRQAPGKGLEWVSSISPSGGRTKYADSVKGRFTISRDNSKNTLYLQMNSLRAEDTAVYYCAKDLGGGYYYYYGMDVWGQGTLVTVSS

SEQ ID NO: 1016 - DNA, 26 bp, Artificial Sequence
  Oligonucleotide primer ZC56846
gccaccatgctggggagcagagctgt

SEQ ID NO: 1017 - DNA, 22 bp, Artificial Sequence
  Oligonucleotide primer ZC56855
tctgagtgccatccttgagctg

SEQ ID NO: 1018 - DNA, 498 bp, Macaca fascicularis
atgactcctgggaagacctcattggtgctactgctgctgctgctgagcctggaggccatagtgaaggcaggaatagcaatcccacgaaattcaggatgcccaaattctgaggacaagaacttcccccggactgtgatggtcaacctgaacatccataaccggaataccagtaccaatcccaaaaggtcctcagattactacaaccgatccacctcaccttggaatctccaccgcaatgaggaccctgagagatatccctctgtgatctgggaggcaaaatgccgccacttaggctgcgtcaaggctgatgggaacgtagactaccacatgaactctgtccccatccagcaagagatcctggtcctgcgcagggagcctccacactgccccaactccttccggctggagaagatactggtgtccgtgggctgcacctgtgtcacccccattgtccaccatgtagccggttccggtggccatcaccatcaccatcactaa

SEQ ID NO: 1019 - protein, 165 aa, Macaca fascicularis
MTPGKTSLVLLLLLLSLEAIVKAGIAIPRNSGCPNSEDKNFPRTVMVNLNIHNRNTSTNPKRSSDYYNRSTSPWNLHRNEDPERYPSVIWEAKCRHLGCVKADGNVDYHMNSVPIQQEILVLRREPPHCPNSFRLEKILVSVGCTCVTPIVHHVAGSGGHHHHHH

SEQ ID NO: 1020 - DNA, 522 bp, Macaca fascicularis
atgacagtgaagaccctgcatggcccagtcatggtcaagtacttgctgctgttgatattgggacttgcctttctgaatgaggtggcagctaggaaaatccccaaagtaggacatacttttttccaaaagcctgagagttgcccacctgtgccagaaggtagtatgaagcttgacactggcatcatcaatgaaaaccagcgtgtttccatgtcacgtaacatcgagagccgctccacctccccctggaattacactgtcacttgggaccccaaccggtatccctcggaagttgtacaggcccagtgtaagcacttgggctgcatcaatgctcaaggaaaggaagacatctccatgaattccgttcccatccagcaagagaccctggtcctccggaggaagcaccaaggctgctctgtttctttccagttggagaaggtgctggtgactgttggctgcacctgcgtcacccccgtcgtccaccatgtgcagggttccggtggccatcaccatcaccatcactaa

SEQ ID NO: 1021 - protein, 173 aa, Macaca fascicularis
MTVKTLHGPVMVKYLLLLILGLAFLNEVAARKIPKVGHTFFQKPESCPPVPEGSMKLDTGIINENQRVSMSRNIESRSTSPWNYTVTWDPNRYPSEVVQAQCKHLGCINAQGKEDISMNSVPIQQETLVLRRKHQGCSVSFQLEKVLVTVGCTCVTPVVHHVQGSGGHHHHHH

SEQ ID NO: 1022 - protein, 155 aa, Macaca fascicularis
MTPGKTSLVLLLLLLSLEAIVKAGIAIPRNSGCPNSEDKNFPRTVMVNLNIHNRNTSTNPKRSSDYYNRSTSPWNLHRNEDPERYPSVIWEAKCRHLGCVKADGNVDYHMNSVPIQQEILVLRREPRHCPNSFRLEKILVSVGCTCVTPIVHHVA

SEQ ID NO: 1023 - protein, 158 aa, Mus musculus
MSPGRASSVSLMLLLLLSLAATVKAAAIIPQSSACPNTEAKDFLQNVKVNLKVFNSLGAKVSSRRPSDYLNRSTSPWTLHRNEDPDRYPSVIWEAQCRHQRCVNAEGKLDHHMNSVLIQQEILVLKREPESCPFTFRVEKMLVGVGCTCVASIVRQAA

SEQ ID NO: 1024 - protein, 140 aa, Rattus norvegicus
MCLMLLLLLNLEATVKAAVLIPQSSVCPNAEANNFLQNVKVNLKVINSLSSKASSRRPSDYLNRSTSPWTLSRNEDPDRYPSVIWEAQCRHQRCVNAEGKLDHHMNSVLIQQEILVLKREPEKCPFTFRVEKMLVGVGCT

SEQ ID NO: 1025 - protein, 198 aa, Macaca fascicularis
MLGSRAVMLLLLLSWTAQGRAVPGGSSPAWAQCQQLSQKLCTLAWSAHPLVGHMDLREEGDEETTNDVPHIQCGDGCDPQGLRDNSQFCLQRIRQGLIFYEKLLGSDIFTGEPSLLPDSPVGQLHASLLGLSQLLQPEGHHWETQQIPSPSPSQPWQRLLLRFKILRSLQAFVAVAARVFAHGAATLSPSQQLKDGTQ

SEQ ID NO: 1026 - protein, 196 aa, Mus musculus; identical to SEQ ID NO: 24

SEQ ID NO: 1027 - protein, 196 aa, Rattus norvegicus
MLDCRAIILLWLLPWATQGLAVPRSSSPDWAQCQQLSRNLCTLAWSAHTPVGQMDLLREEGEEETKSDVPRIQCGDGCDPQGLKDNSQFCLQRIRQGLVFYKHLLDSDIFTGEPSLLPDSPVDQLHTSLLGLSQLLQPEDHHWETQQMPRLSPSQQWQRSLLRSKILRSLQAFLAIAARVFAHGAATLTEPLVPTA

What is claimed is:

1. An antibody that binds a polypeptide consisting of IL-23 (SEQ ID NO: 4), wherein the antibody comprises:
   a) a light chain variable region comprising:
      i) a light chain CDR1 comprising the amino acid sequence from 23 to 36 of SEQ ID NO: 1014; and
      ii) a light chain CDR2 comprising the amino acid sequence from 52 to 58 of SEQ ID NO: 1014; and
      iii) a light chain CDR3 comprising the amino acid sequence from 91 to 102 of SEQ ID NO: 1014; and
   b) a heavy chain variable region comprising:
      i) a heavy chain CDR1 comprising the amino acid sequence from 31 to 35 of SEQ ID NO: 1015; and
      ii) a heavy chain CDR2 comprising the amino acid sequence from 50 to 66 of SEQ ID NO: 1015; and
      iii) a heavy chain CDR3 comprising the amino acid sequence from 99 to 112 of SEQ ID NO: 1015.

2. The antibody of claim 1, wherein the antibody is an antibody fragment.

3. The antibody of claim 2, wherein said antibody fragment is selected from the group consisting of Fv, Fab, Fab', F(ab)$_2$, and F(ab')$_2$.

4. The antibody of claim 1, wherein the antibody is a single chain molecule.

5. The antibody of claim 1, wherein the antibody is a bispecific molecule that also binds IL-17A (SEQ ID NO:2).

6. An antibody that binds a polypeptide consisting of SEQ ID NO: 4, wherein the antibody comprises a light chain variable region comprising SEQ ID NO: 1014 and a heavy chain variable region comprising SEQ ID NO: 1015.

7. The antibody of claim 6, wherein the antibody is an antibody fragment.

8. The antibody of claim 7, wherein said antibody fragment is selected from the group consisting of Fv, Fab, Fab', F(ab)$_2$, and F(ab')$_2$.

9. The antibody of claim 6, wherein the antibody is a single chain molecule.

10. The antibody of claim 6, wherein the antibody is a bispecific molecule that also binds IL-17A (SEQ ID NO:2).

11. A monoclonal antibody or fragment thereof that binds an epitope consisting of amino acid residues 55 to 66 of SEQ ID NO: 4.

12. A monoclonal antibody or fragment thereof that binds an epitope consisting of amino acid residues 137 to 146 of SEQ ID NO: 4.

13. A monoclonal antibody or fragment thereof that binds an epitope consisting of amino acid residues 74 to 85 of SEQ ID NO: 4.

14. A monoclonal antibody or fragment thereof that binds an epitope consisting of amino acid residues 155 to 164 of SEQ ID NO: 4.

* * * * *